United States Patent 12,553,037 (ENGINEERED CLASS 2, TYPE V REPRESSOR SYSTEMS) - sequence listing, part 5

SEQ ID NO: 47045 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtacgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47046 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacacgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47047 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcacgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47048 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggacgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47049 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtacgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47050 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacacgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47051 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttacgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47052 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctacgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47053 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcacgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47054 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgacgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47055 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacacgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47056 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggacgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47057 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctacgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47058 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgacggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47059 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaacgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47060 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47061 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactacggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47062 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgacgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47063 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatacggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47064 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatacgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47065 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagacgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47066 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgacggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47067 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagacgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47068 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgacgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47069 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaacggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47070 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagacgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47071 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtacgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47072 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgacggagcacggcagaatagccaagttcagcaaagtgaggaccattaccaccaggtcaaactctataaagcagggcaaagaccagcatttccccgtcttcatgaacgagacgtcggaagagc

SEQ ID NO: 47073 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagacgcacggcagaatagccaagttcagcaaagtgaggaccattaccaccaggtcaaactctataaagcagggcaaagaccagcatttccccgtcttcatgaacgagacgtcggaagagc

SEQ ID NO: 47074 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacacgggcagaatagccaagttcagcaaagtgaggaccattaccaccaggtcaaactctataaagcagggcaaagaccagcatttccccgtcttcatgaacgagacgtcggaagagc

SEQ ID NO: 47075 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcacgagaatagccaagttcagcaaagtgaggaccattaccaccaggtcaaactctataaagcagggcaaagaccagcatttccccgtcttcatgaacgagacgtcggaagagc

SEQ ID NO: 47076 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaacgatagccaagttcagcaaagtgaggaccattaccaccaggtcaaactctataaagcagggcaaagaccagcatttccccgtcttcatgaacgagacgtcggaagagc

SEQ ID NO: 47077 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataacggccaagttcagcaaagtgaggaccattaccaccaggtcaaactctataaagcagggcaaagaccagcatttccccgtcttcatgaacgagacgtcggaagagc

SEQ ID NO: 47078 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccacgaagttcagcaaagtgaggaccattaccaccaggtcaaactctataaagcagggcaaagaccagcatttccccgtcttcatgaacgagacgtcggaagagc

SEQ ID NO: 47079 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagacgttcagcaaagtgaggaccattaccaccaggtcaaactctataaagcagggcaaagaccagcatttccccgtcttcatgaacgagacgtcggaagagc

SEQ ID NO: 47080 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcacgagcaaagtgaggaccattaccaccaggtcaaactctataaagcagggcaaagaccagcatttccccgtcttcatgaacgagacgtcggaagagc

SEQ ID NO: 47081 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcacgaaagtgaggaccattaccaccaggtcaaactctataaagcagggcaaagaccagcatttccccgtcttcatgaacgagacgtcggaagagc

SEQ ID NO: 47082 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaacggtgaggaccattaccaccaggtcaaactctataaagcagggcaaagaccagcatttccccgtcttcatgaacgagacgtcggaagagc

SEQ ID NO: 47083 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgacgaggaccattaccaccaggtcaaactctataaagcagggcaaagaccagcatttccccgtcttcatgaacgagacgtcggaagagc

SEQ ID NO: 47084 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacgaccattaccaccaggtcaaactctataaagcagggcaaagaccagcatttccccgtcttcatgaacgagacgtcggaagagc

SEQ ID NO: 47085 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccacgattaccaccaggtcaaactctataaagcagggcaaagaccagcatttccccgtcttcatgaacgagacgtcggaagagc

SEQ ID NO: 47086 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacgaccaccaggtcaaactctataaagcagggcaaagaccagcatttccccgtcttcatgaacgagacgtcggaagagc

SEQ ID NO: 47087 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacgaccaggtcaaactctataaagcagggcaaagaccagcatttccccgtcttcatgaacgagacgtcggaagagc

SEQ ID NO: 47088 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccacgaggtcaaactctataaagcagggcaaagaccagcatttccccgtcttcatgaacgagacgtcggaagagc

SEQ ID NO: 47089 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggacgtcaaactctataaagcagggcaaagaccagcatttccccgtcttcatgaacgagacgtcggaagagc

SEQ ID NO: 47090 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaacgaactctataaagcagggcaaagaccagcatttccccgtcttcatgaacgagacgtcggaagagc

SEQ ID NO: 47091 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacacgtctataaagcagggcaaagaccagcatttccccgtcttcatgaacgagacgtcggaagagc

SEQ ID NO: 47092 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctacgataaagcagggcaaagaccagcatttccccgtcttcatgaacgagacgtcggaagagc

SEQ ID NO: 47093 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataacgaagcagggcaaagaccagcatttccccgtcttcatgaacgagacgtcggaagagc

SEQ ID NO: 47094 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagacgcagggcaaagaccagcatttccccgtcttcatgaacgagacgtcggaagagc

SEQ ID NO: 47095 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagacgggcaaagaccagcatttccccgtcttcatgaacgagacgtcggaagagc

SEQ ID NO: 47096 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcacgaaagaccagcatttccccgtcttcatgaacgagacgtcggaagagc

SEQ ID NO: 47097 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaacggaccagcatttccccgtcttcatgaacgagacgtcggaagagc

SEQ ID NO: 47098 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacacgcagcatttccccgtcttcatgaacgagacgtcggaagagc

SEQ ID NO: 47099 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagacgcatttccccgtcttcatgaacgagacgtcggaagagc

SEQ ID NO: 47100 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatacgttccccgtcttcatgaacgagacgtcggaagagc

SEQ ID NO: 47101 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcacgcccgtcttcatgaacgagacgtcggaagagc

SEQ ID NO: 47102 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccacggtcttcatgaacgagacgtcggaagagc

SEQ ID NO: 47103 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcacgttcatgaacgagacgtcggaagagc

SEQ ID NO: 47104 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcacgatgaacgagacgtcggaagagc

SEQ ID NO: 47105 - RNA, 299 nt, synthetic construct
  source 1..299: mol_type = other RNA
cgctcttccgcgtctcaagagggacaccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47106 - RNA, 299 nt, synthetic construct
  source 1..299: mol_type = other RNA
cgctcttccgcgtctcaagagggacatcacctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47107 - RNA, 299 nt, synthetic construct
  source 1..299: mol_type = other RNA
cgctcttccgcgtctcaagagggacatctcgacccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47108 - RNA, 299 nt, synthetic construct
  source 1..299: mol_type = other RNA
cgctcttccgcgtctcaagagggacatctcgcgaacctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47109 - RNA, 299 nt, synthetic construct
  source 1..299: mol_type = other RNA
cgctcttccgcgtctcaagagggacatctcgcgatttacccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47110 - RNA, 299 nt, synthetic construct
  source 1..299: mol_type = other RNA
cgctcttccgcgtctcaagagggacatctcgcgatttcttaccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47111 - RNA, 299 nt, synthetic construct
  source 1..299: mol_type = other RNA
cgctcttccgcgtctcaagagggacatctcgcgatttcttgagacctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47112 - RNA, 299 nt, synthetic construct
  source 1..299: mol_type = other RNA
cgctcttccgcgtctcaagagggacatctcgcgatttcttgagtctaccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47113 - RNA, 299 nt, synthetic construct
  source 1..299: mol_type = other RNA
cgctcttccgcgtctcaagagggacatctcgcgatttcttgagtctaacacccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47114 - RNA, 299 nt, synthetic construct
  source 1..299: mol_type = other RNA
cgctcttccgcgtctcaagagggacatctcgcgatttcttgagtctaaccccaccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47115 - RNA, 299 nt, synthetic construct
  source 1..299: mol_type = other RNA
cgctcttccgcgtctcaagagggacatctcgcgatttcttgagtctaaccccgtgaccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47116 - RNA, 299 nt, synthetic construct
  source 1..299: mol_type = other RNA
cgctcttccgcgtctcaagagggacatctcgcgatttcttgagtctaaccccgtgatgaccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47117 - RNA, 299 nt, synthetic construct
  source 1..299: mol_type = other RNA
cgctcttccgcgtctcaagagggacatctcgcgatttcttgagtctaaccccgtgatgattaccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47118 - RNA, 299 nt, synthetic construct
  source 1..299: mol_type = other RNA
cgctcttccgcgtctcaagagggacatctcgcgatttcttgagtctaaccccgtgatgattgacaccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47119 - RNA, 299 nt, synthetic construct
  source 1..299: mol_type = other RNA
cgctcttccgcgtctcaagagggacatctcgcgatttcttgagtctaaccccgtgatgattgacgccaccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47120 - RNA, 299 nt, synthetic construct
  source 1..299: mol_type = other RNA
cgctcttccgcgtctcaagagggacatctcgcgatttcttgagtctaaccccgtgatgattgacgccaaaaccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47121 - RNA, 299 nt, synthetic construct
  source 1..299: mol_type = other RNA
cgctcttccgcgtctcaagagggacatctcgcgatttcttgagtctaaccccgtgatgattgacgccaaagaaaccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47122 - RNA, 299 nt, synthetic construct
  source 1..299: mol_type = other RNA
cgctcttccgcgtctcaagagggacatctcgcgatttcttgagtctaaccccgtgatgattgacgccaaagaagtgacctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47123 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctaccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47124 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctaccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47125 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaacccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47126 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47127 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggaccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47128 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccacccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47129 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtacctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47130 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacaccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47131 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcacctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47132 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggaccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47133 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47134 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacacccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47135 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttacccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47136 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47137 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47138 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47139 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47140 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggacccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47141 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47142 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgaccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47143 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaacctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47144 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47145 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47146 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47147 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47148 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47149 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47150 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47151 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47152 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgacccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47153 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaaccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47154 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagacctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47155 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47156 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgaccgagcacggcagaatagccaagttcagcaaagtgaggaccattaccaccaggtcaaactctataaagcagggcaaagaccagcatttccccgtcttcatgaacgagacgtcggaagagc

SEQ ID NO: 47157 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagacccacggcagaatagccaagttcagcaaagtgaggaccattaccaccaggtcaaactctataaagcagggcaaagaccagcatttccccgtcttcatgaacgagacgtcggaagagc

SEQ ID NO: 47158 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaccggcagaatagccaagttcagcaaagtgaggaccattaccaccaggtcaaactctataaagcagggcaaagaccagcatttccccgtcttcatgaacgagacgtcggaagagc

SEQ ID NO: 47159 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaccagaatagccaagttcagcaaagtgaggaccattaccaccaggtcaaactctataaagcagggcaaagaccagcatttccccgtcttcatgaacgagacgtcggaagagc

SEQ ID NO: 47160 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaccatagccaagttcagcaaagtgaggaccattaccaccaggtcaaactctataaagcagggcaaagaccagcatttccccgtcttcatgaacgagacgtcggaagagc

SEQ ID NO: 47161 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaccgccaagttcagcaaagtgaggaccattaccaccaggtcaaactctataaagcagggcaaagaccagcatttccccgtcttcatgaacgagacgtcggaagagc

SEQ ID NO: 47162 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaccaagttcagcaaagtgaggaccattaccaccaggtcaaactctataaagcagggcaaagaccagcatttccccgtcttcatgaacgagacgtcggaagagc

SEQ ID NO: 47163 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaccttcagcaaagtgaggaccattaccaccaggtcaaactctataaagcagggcaaagaccagcatttccccgtcttcatgaacgagacgtcggaagagc

SEQ ID NO: 47164 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaccagcaaagtgaggaccattaccaccaggtcaaactctataaagcagggcaaagaccagcatttccccgtcttcatgaacgagacgtcggaagagc

SEQ ID NO: 47165 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaccaaagtgaggaccattaccaccaggtcaaactctataaagcagggcaaagaccagcatttccccgtcttcatgaacgagacgtcggaagagc

SEQ ID NO: 47166 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaccgtgaggaccattaccaccaggtcaaactctataaagcagggcaaagaccagcatttccccgtcttcatgaacgagacgtcggaagagc

SEQ ID NO: 47167 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaccaggaccattaccaccaggtcaaactctataaagcagggcaaagaccagcatttccccgtcttcatgaacgagacgtcggaagagc

SEQ ID NO: 47168 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaccattaccaccaggtcaaactctataaagcagggcaaagaccagcatttccccgtcttcatgaacgagacgtcggaagagc

SEQ ID NO: 47169 - RNA, 299 nt, synthetic construct; identical to SEQ ID NO: 47168
  source 1..299: mol_type = other RNA

SEQ ID NO: 47170 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaccaggtcaaactctataaagcagggcaaagaccagcatttccccgtcttcatgaacgagacgtcggaagagc

SEQ ID NO: 47171 - RNA, 299 nt, synthetic construct; identical to SEQ ID NO: 47170
  source 1..299: mol_type = other RNA

SEQ ID NO: 47172 - RNA, 299 nt, synthetic construct; identical to SEQ ID NO: 47170
  source 1..299: mol_type = other RNA

SEQ ID NO: 47173 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggacctcaaactctataaagcagggcaaagaccagcatttccccgtcttcatgaacgagacgtcggaagagc

SEQ ID NO: 47174 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaccaactctataaagcagggcaaagaccagcatttccccgtcttcatgaacgagacgtcggaagagc

SEQ ID NO: 47175 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacacctctataaagcagggcaaagaccagcatttccccgtcttcatgaacgagacgtcggaagagc

SEQ ID NO: 47176 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaccataaagcagggcaaagaccagcatttccccgtcttcatgaacgagacgtcggaagagc

SEQ ID NO: 47177 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaccaagcagggcaaagaccagcatttccccgtcttcatgaacgagacgtcggaagagc

SEQ ID NO: 47178 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagacccagggcaaagaccagcatttccccgtcttcatgaacgagacgtcggaagagc

SEQ ID NO: 47179 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaccggcaaagaccagcatttccccgtcttcatgaacgagacgtcggaagagc

SEQ ID NO: 47180 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaccaaagaccagcatttccccgtcttcatgaacgagacgtcggaagagc

SEQ ID NO: 47181 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaaccgaccagcatttccccgtcttcatgaacgagacgtcggaagagc

SEQ ID NO: 47182 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacacccagcatttccccgtcttcatgaacgagacgtcggaagagc

SEQ ID NO: 47183 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagacccatttccccgtcttcatgaacgagacgtcggaagagc

SEQ ID NO: 47184 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataccttccccgtcttcatgaacgagacgtcggaagagc

SEQ ID NO: 47185 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcacccccgtcttcatgaacgagacgtcggaagagc

SEQ ID NO: 47186 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaccgtcttcatgaacgagacgtcggaagagc

SEQ ID NO: 47187 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaccttcatgaacgagacgtcggaagagc

SEQ ID NO: 47188 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcaccatgaacgagacgtcggaagagc

SEQ ID NO: 47189 - RNA, 299 nt, synthetic construct
  source 1..299: mol_type = other RNA
cgctcttccgcgtctcaagagggactagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47190 - RNA, 299 nt, synthetic construct
  source 1..299: mol_type = other RNA
cgctcttccgcgtctcaagagggacatctagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47191 - RNA, 299 nt, synthetic construct
  source 1..299: mol_type = other RNA
cgctcttccgcgtctcaagagggacatctcgtagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47192 - RNA, 299 nt, synthetic construct
  source 1..299: mol_type = other RNA
cgctcttccgcgtctcaagagggacatctcgcgatagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47193 - RNA, 299 nt, synthetic construct
  source 1..299: mol_type = other RNA
cgctcttccgcgtctcaagagggacatctcgcgattttagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47194 - RNA, 299 nt, synthetic construct
  source 1..299: mol_type = other RNA
cgctcttccgcgtctcaagagggacatctcgcgatttctttaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47195 - RNA, 299 nt, synthetic construct
  source 1..299: mol_type = other RNA
cgctcttccgcgtctcaagagggacatctcgcgatttcttgagtagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47196 - RNA, 299 nt, synthetic construct
  source 1..299: mol_type = other RNA
cgctcttccgcgtctcaagagggacatctcgcgatttcttgagtcttagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47197 - RNA, 299 nt, synthetic construct
  source 1..299: mol_type = other RNA
cgctcttccgcgtctcaagagggacatctcgcgatttcttgagtctaactagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47198 - RNA, 299 nt, synthetic construct
  source 1..299: mol_type = other RNA
cgctcttccgcgtctcaagagggacatctcgcgatttcttgagtctaacccctaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47199 - RNA, 299 nt, synthetic construct
  source 1..299: mol_type = other RNA
cgctcttccgcgtctcaagagggacatctcgcgatttcttgagtctaaccccgtgtagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47200 - RNA, 299 nt, synthetic construct
  source 1..299: mol_type = other RNA
cgctcttccgcgtctcaagagggacatctcgcgatttcttgagtctaaccccgtgatgtagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47201 - RNA, 299 nt, synthetic construct
  source 1..299: mol_type = other RNA
cgctcttccgcgtctcaagagggacatctcgcgatttcttgagtctaaccccgtgatgatttaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47202 - RNA, 299 nt, synthetic construct
  source 1..299: mol_type = other RNA
cgctcttccgcgtctcaagagggacatctcgcgatttcttgagtctaaccccgtgatgattgactaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47203 - RNA, 299 nt, synthetic construct
  source 1..299: mol_type = other RNA
cgctcttccgcgtctcaagagggacatctcgcgatttcttgagtctaaccccgtgatgattgacgcctagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47204 - RNA, 299 nt, synthetic construct
  source 1..299: mol_type = other RNA
cgctcttccgcgtctcaagagggacatctcgcgatttcttgagtctaaccccgtgatgattgacgccaaataggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47205 - RNA, 299 nt, synthetic construct
  source 1..299: mol_type = other RNA
cgctcttccgcgtctcaagagggacatctcgcgatttcttgagtctaaccccgtgatgattgacgccaaagaataggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47206 - RNA, 299 nt, synthetic construct
  source 1..299: mol_type = other RNA
cgctcttccgcgtctcaagagggacatctcgcgatttcttgagtctaaccccgtgatgattgacgccaaagaagtgtagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47207 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcttaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47208 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcttaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47209 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcatagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47210 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacactagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47211 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggtaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47212 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcctagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47213 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47214 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttactagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47215 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47216 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggtagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47217 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggttagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47218 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaactagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47219 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctttagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47220 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccttagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47221 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47222 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47223 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47224 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47225 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47226 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47227 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47228 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47229 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47230 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47231 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47232 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47233 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47234 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47235 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47236 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47237 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaataggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47238 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47239 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47240 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtaggagcacggcagaatagccaagttcagcaaagtgaggaccattaccaccaggtcaaactctataaagcagggcaaagaccagcatttccccgtcttcatgaacgagacgtcggaagagc

SEQ ID NO: 47241 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtagcacggcagaatagccaagttcagcaaagtgaggaccattaccaccaggtcaaactctataaagcagggcaaagaccagcatttccccgtcttcatgaacgagacgtcggaagagc

SEQ ID NO: 47242 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactagggcagaatagccaagttcagcaaagtgaggaccattaccaccaggtcaaactctataaagcagggcaaagaccagcatttccccgtcttcatgaacgagacgtcggaagagc

SEQ ID NO: 47243 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctagagaatagccaagttcagcaaagtgaggaccattaccaccaggtcaaactctataaagcagggcaaagaccagcatttccccgtcttcatgaacgagacgtcggaagagc

SEQ ID NO: 47244 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatagatagccaagttcagcaaagtgaggaccattaccaccaggtcaaactctataaagcagggcaaagaccagcatttccccgtcttcatgaacgagacgtcggaagagc

SEQ ID NO: 47245 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatataggccaagttcagcaaagtgaggaccattaccaccaggtcaaactctataaagcagggcaaagaccagcatttccccgtcttcatgaacgagacgtcggaagagc

SEQ ID NO: 47246 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctagaagttcagcaaagtgaggaccattaccaccaggtcaaactctataaagcagggcaaagaccagcatttccccgtcttcatgaacgagacgtcggaagagc

SEQ ID NO: 47247 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtagttcagcaaagtgaggaccattaccaccaggtcaaactctataaagcagggcaaagaccagcatttccccgtcttcatgaacgagacgtcggaagagc

SEQ ID NO: 47248 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctagagcaaagtgaggaccattaccaccaggtcaaactctataaagcagggcaaagaccagcatttccccgtcttcatgaacgagacgtcggaagagc

SEQ ID NO: 47249 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctagaaagtgaggaccattaccaccaggtcaaactctataaagcagggcaaagaccagcatttccccgtcttcatgaacgagacgtcggaagagc

SEQ ID NO: 47250 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaataggtgaggaccattaccaccaggtcaaactctataaagcagggcaaagaccagcatttccccgtcttcatgaacgagacgtcggaagagc

SEQ ID NO: 47251 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtagaggaccattaccaccaggtcaaactctataaagcagggcaaagaccagcatttccccgtcttcatgaacgagacgtcggaagagc

SEQ ID NO: 47252 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtagaccattaccaccaggtcaaactctataaagcagggcaaagaccagcatttccccgtcttcatgaacgagacgtcggaagagc

SEQ ID NO: 47253 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctagattaccaccaggtcaaactctataaagcagggcaaagaccagcatttccccgtcttcatgaacgagacgtcggaagagc

SEQ ID NO: 47254 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttagaccaccaggtcaaactctataaagcagggcaaagaccagcatttccccgtcttcatgaacgagacgtcggaagagc

SEQ ID NO: 47255 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctagaccaggtcaaactctataaagcagggcaaagaccagcatttccccgtcttcatgaacgagacgtcggaagagc

SEQ ID NO: 47256 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctagaggtcaaactctataaagcagggcaaagaccagcatttccccgtcttcatgaacgagacgtcggaagagc

SEQ ID NO: 47257 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtagtcaaactctataaagcagggcaaagaccagcatttccccgtcttcatgaacgagacgtcggaagagc

SEQ ID NO: 47258 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatagaactctataaagcagggcaaagaccagcatttccccgtcttcatgaacgagacgtcggaagagc

SEQ ID NO: 47259 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactagtctataaagcagggcaaagaccagcatttccccgtcttcatgaacgagacgtcggaagagc

SEQ ID NO: 47260 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttagataaagcagggcaaagaccagcatttccccgtcttcatgaacgagacgtcggaagagc

SEQ ID NO: 47261 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatagaagcagggcaaagaccagcatttccccgtcttcatgaacgagacgtcggaagagc

SEQ ID NO: 47262 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtagcagggcaaagaccagcatttccccgtcttcatgaacgagacgtcggaagagc

SEQ ID NO: 47263 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtagggcaaagaccagcatttccccgtcttcatgaacgagacgtcggaagagc

SEQ ID NO: 47264 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctagaaagaccagcatttccccgtcttcatgaacgagacgtcggaagagc

SEQ ID NO: 47265 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaataggaccagcatttccccgtcttcatgaacgagacgtcggaagagc

SEQ ID NO: 47266 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactagcagcatttccccgtcttcatgaacgagacgtcggaagagc

SEQ ID NO: 47267 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtagcatttccccgtcttcatgaacgagacgtcggaagagc

SEQ ID NO: 47268 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattagttccccgtcttcatgaacgagacgtcggaagagc

SEQ ID NO: 47269 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctagcccgtcttcatgaacgagacgtcggaagagc

SEQ ID NO: 47270 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctaggtcttcatgaacgagacgtcggaagagc

SEQ ID NO: 47271 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctagttcatgaacgagacgtcggaagagc

SEQ ID NO: 47272 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttctagatgaacgagacgtcggaagagc

SEQ ID NO: 47273 - RNA, 299 nt, synthetic construct
  source 1..299: mol_type = other RNA
cgctcttccgcgtctcaagagggactacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47274 - RNA, 299 nt, synthetic construct
  source 1..299: mol_type = other RNA
cgctcttccgcgtctcaagagggacatctactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47275 - RNA, 299 nt, synthetic construct
  source 1..299: mol_type = other RNA
cgctcttccgcgtctcaagagggacatctcgtaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47276 - RNA, 299 nt, synthetic construct
  source 1..299: mol_type = other RNA
cgctcttccgcgtctcaagagggacatctcgcgatactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47277 - RNA, 299 nt, synthetic construct
  source 1..299: mol_type = other RNA
cgctcttccgcgtctcaagagggacatctcgcgattttaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47278 - RNA, 299 nt, synthetic construct
  source 1..299: mol_type = other RNA
cgctcttccgcgtctcaagagggacatctcgcgatttctttacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47279 - RNA, 299 nt, synthetic construct
  source 1..299: mol_type = other RNA
cgctcttccgcgtctcaagagggacatctcgcgatttcttgagtactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47280 - RNA, 299 nt, synthetic construct
  source 1..299: mol_type = other RNA
cgctcttccgcgtctcaagagggacatctcgcgatttcttgagtcttacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47281 - RNA, 299 nt, synthetic construct
  source 1..299: mol_type = other RNA
cgctcttccgcgtctcaagagggacatctcgcgatttcttgagtctaactaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47282 - RNA, 299 nt, synthetic construct
  source 1..299: mol_type = other RNA
cgctcttccgcgtctcaagagggacatctcgcgatttcttgagtctaacccctacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47283 - RNA, 299 nt, synthetic construct
  source 1..299: mol_type = other RNA
cgctcttccgcgtctcaagagggacatctcgcgatttcttgagtctaaccccgtgtacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47284 - RNA, 299 nt, synthetic construct
  source 1..299: mol_type = other RNA
cgctcttccgcgtctcaagagggacatctcgcgatttcttgagtctaaccccgtgatgtacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47285 - RNA, 299 nt, synthetic construct
  source 1..299: mol_type = other RNA
cgctcttccgcgtctcaagagggacatctcgcgatttcttgagtctaaccccgtgatgatttacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47286 - RNA, 299 nt, synthetic construct
  source 1..299: mol_type = other RNA
cgctcttccgcgtctcaagagggacatctcgcgatttcttgagtctaaccccgtgatgattgactacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47287 - RNA, 299 nt, synthetic construct
  source 1..299: mol_type = other RNA
cgctcttccgcgtctcaagagggacatctcgcgatttcttgagtctaaccccgtgatgattgacgcctacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47288 - RNA, 299 nt, synthetic construct
  source 1..299: mol_type = other RNA
cgctcttccgcgtctcaagagggacatctcgcgatttcttgagtctaaccccgtgatgattgacgccaaatacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47289 - RNA, 299 nt, synthetic construct
  source 1..299: mol_type = other RNA
cgctcttccgcgtctcaagagggacatctcgcgatttcttgagtctaaccccgtgatgattgacgccaaagaatacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47290 - RNA, 299 nt, synthetic construct
  source 1..299: mol_type = other RNA
cgctcttccgcgtctcaagagggacatctcgcgatttcttgagtctaaccccgtgatgattgacgccaaagaagtgtactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47291 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcttacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47292 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcttacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47293 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcataccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47294 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacactacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47295 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggtacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47296 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcctaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47297 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47298 - RNA, 299 nt, synthetic construct; identical to SEQ ID NO: 47297
  source 1..299: mol_type = other RNA

SEQ ID NO: 47299 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47300 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggtacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47301 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggttacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47302 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaactaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47303 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctttaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47304 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccttacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47305 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47306 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47307 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47308 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47309 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47310 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47311 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47312 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47313 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47314 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47315 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47316 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47317 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47318 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47319 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47320 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47321 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47322 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47323 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47324 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtacgagcacggcagaatagccaagttcagcaaagtgaggaccattaccaccaggtcaaactctataaagcagggcaaagaccagcatttccccgtcttcatgaacgagacgtcggaagagc

SEQ ID NO: 47325 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtaccacggcagaatagccaagttcagcaaagtgaggaccattaccaccaggtcaaactctataaagcagggcaaagaccagcatttccccgtcttcatgaacgagacgtcggaagagc

SEQ ID NO: 47326 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactacggcagaatagccaagttcagcaaagtgaggaccattaccaccaggtcaaactctataaagcagggcaaagaccagcatttccccgtcttcatgaacgagacgtcggaagagc

SEQ ID NO: 47327 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctacagaatagccaagttcagcaaagtgaggaccattaccaccaggtcaaactctataaagcagggcaaagaccagcatttccccgtcttcatgaacgagacgtcggaagagc

SEQ ID NO: 47328 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatacatagccaagttcagcaaagtgaggaccattaccaccaggtcaaactctataaagcagggcaaagaccagcatttccccgtcttcatgaacgagacgtcggaagagc

SEQ ID NO: 47329 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatacgccaagttcagcaaagtgaggaccattaccaccaggtcaaactctataaagcagggcaaagaccagcatttccccgtcttcatgaacgagacgtcggaagagc

SEQ ID NO: 47330 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctacaagttcagcaaagtgaggaccattaccaccaggtcaaactctataaagcagggcaaagaccagcatttccccgtcttcatgaacgagacgtcggaagagc

SEQ ID NO: 47331 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtacttcagcaaagtgaggaccattaccaccaggtcaaactctataaagcagggcaaagaccagcatttccccgtcttcatgaacgagacgtcggaagagc

SEQ ID NO: 47332 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctacagcaaagtgaggaccattaccaccaggtcaaactctataaagcagggcaaagaccagcatttccccgtcttcatgaacgagacgtcggaagagc

SEQ ID NO: 47333 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctacaaagtgaggaccattaccaccaggtcaaactctataaagcagggcaaagaccagcatttccccgtcttcatgaacgagacgtcggaagagc

SEQ ID NO: 47334 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatacgtgaggaccattaccaccaggtcaaactctataaagcagggcaaagaccagcatttccccgtcttcatgaacgagacgtcggaagagc

SEQ ID NO: 47335 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtacaggaccattaccaccaggtcaaactctataaagcagggcaaagaccagcatttccccgtcttcatgaacgagacgtcggaagagc

SEQ ID NO: 47336 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtacaccattaccaccaggtcaaactctataaagcagggcaaagaccagcatttccccgtcttcatgaacgagacgtcggaagagc

SEQ ID NO: 47337 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctacattaccaccaggtcaaactctataaagcagggcaaagaccagcatttccccgtcttcatgaacgagacgtcggaagagc

SEQ ID NO: 47338 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttacaccaccaggtcaaactctataaagcagggcaaagaccagcatttccccgtcttcatgaacgagacgtcggaagagc

SEQ ID NO: 47339 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctacaccaggtcaaactctataaagcagggcaaagaccagcatttccccgtcttcatgaacgagacgtcggaagagc

SEQ ID NO: 47340 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctacaggtcaaactctataaagcagggcaaagaccagcatttccccgtcttcatgaacgagacgtcggaagagc

SEQ ID NO: 47341 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtactcaaactctataaagcagggcaaagaccagcatttccccgtcttcatgaacgagacgtcggaagagc

SEQ ID NO: 47342 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatacaactctataaagcagggcaaagaccagcatttccccgtcttcatgaacgagacgtcggaagagc

SEQ ID NO: 47343 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactactctataaagcagggcaaagaccagcatttccccgtcttcatgaacgagacgtcggaagagc

SEQ ID NO: 47344 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttacataaagcagggcaaagaccagcatttccccgtcttcatgaacgagacgtcggaagagc

SEQ ID NO: 47345 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatacaagcagggcaaagaccagcatttccccgtcttcatgaacgagacgtcggaagagc

SEQ ID NO: 47346 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtaccagggcaaagaccagcatttccccgtcttcatgaacgagacgtcggaagagc

SEQ ID NO: 47347 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtacggcaaagaccagcatttccccgtcttcatgaacgagacgtcggaagagc

SEQ ID NO: 47348 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctacaaagaccagcatttccccgtcttcatgaacgagacgtcggaagagc

SEQ ID NO: 47349 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatacgaccagcatttccccgtcttcatgaacgagacgtcggaagagc

SEQ ID NO: 47350 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactaccagcatttccccgtcttcatgaacgagacgtcggaagagc

SEQ ID NO: 47351 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtaccatttccccgtcttcatgaacgagacgtcggaagagc

SEQ ID NO: 47352 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattacttccccgtcttcatgaacgagacgtcggaagagc

SEQ ID NO: 47353 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctaccccgtcttcatgaacgagacgtcggaagagc

SEQ ID NO: 47354 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctacgtcttcatgaacgagacgtcggaagagc

SEQ ID NO: 47355 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctacttcatgaacgagacgtcggaagagc

SEQ ID NO: 47356 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttctacatgaacgagacgtcggaagagc

SEQ ID NO: 47357 - RNA, 299 nt, synthetic construct
  source 1..299: mol_type = other RNA
cgctcttccgcgtctcaagagggacttgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47358 - RNA, 299 nt, synthetic construct
  source 1..299: mol_type = other RNA
cgctcttccgcgtctcaagagggacatcttgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47359 - RNA, 299 nt, synthetic construct
  source 1..299: mol_type = other RNA
cgctcttccgcgtctcaagagggacatctcgttgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47360 - RNA, 299 nt, synthetic construct
  source 1..299: mol_type = other RNA
cgctcttccgcgtctcaagagggacatctcgcgattgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47361 - RNA, 299 nt, synthetic construct
  source 1..299: mol_type = other RNA
cgctcttccgcgtctcaagagggacatctcgcgatttttgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47362 - RNA, 299 nt, synthetic construct
  source 1..299: mol_type = other RNA
cgctcttccgcgtctcaagagggacatctcgcgatttcttttggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47363 - RNA, 299 nt, synthetic construct
  source 1..299: mol_type = other RNA
cgctcttccgcgtctcaagagggacatctcgcgatttcttgagttgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47364 - RNA, 299 nt, synthetic construct
  source 1..299: mol_type = other RNA
cgctcttccgcgtctcaagagggacatctcgcgatttcttgagtctttgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47365 - RNA, 299 nt, synthetic construct
  source 1..299: mol_type = other RNA
cgctcttccgcgtctcaagagggacatctcgcgatttcttgagtctaacttgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47366 - RNA, 299 nt, synthetic construct
  source 1..299: mol_type = other RNA
cgctcttccgcgtctcaagagggacatctcgcgatttcttgagtctaaccccttggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47367 - RNA, 299 nt, synthetic construct
  source 1..299: mol_type = other RNA
cgctcttccgcgtctcaagagggacatctcgcgatttcttgagtctaaccccgtgttgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47368 - RNA, 299 nt, synthetic construct
  source 1..299: mol_type = other RNA
cgctcttccgcgtctcaagagggacatctcgcgatttcttgagtctaaccccgtgatgttgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47369 - RNA, 299 nt, synthetic construct
  source 1..299: mol_type = other RNA
cgctcttccgcgtctcaagagggacatctcgcgatttcttgagtctaaccccgtgatgattttggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47370 - RNA, 299 nt, synthetic construct
  source 1..299: mol_type = other RNA
cgctcttccgcgtctcaagagggacatctcgcgatttcttgagtctaaccccgtgatgattgacttggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47371 - RNA, 299 nt, synthetic construct
  source 1..299: mol_type = other RNA
cgctcttccgcgtctcaagagggacatctcgcgatttcttgagtctaaccccgtgatgattgacgccttgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47372 - RNA, 299 nt, synthetic construct
  source 1..299: mol_type = other RNA
cgctcttccgcgtctcaagagggacatctcgcgatttcttgagtctaaccccgtgatgattgacgccaaattggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47373 - RNA, 299 nt, synthetic construct
  source 1..299: mol_type = other RNA
cgctcttccgcgtctcaagagggacatctcgcgatttcttgagtctaaccccgtgatgattgacgccaaagaattggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47374 - RNA, 299 nt, synthetic construct
  source 1..299: mol_type = other RNA
cgctcttccgcgtctcaagagggacatctcgcgatttcttgagtctaaccccgtgatgattgacgccaaagaagtgttgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47375 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctttggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47376 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctttggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47377 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcattgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47378 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacttgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47379 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggttggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47380 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccttgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47381 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtttgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47382 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47383 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcttgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47384 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggttgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47385 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtttgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47386 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacttgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47387 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttttgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47388 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctttgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47389 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcttgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47390 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgttgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47391 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacttgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47392 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggttgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47393 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47394 - RNA, 299 nt, synthetic construct; identical to SEQ ID NO: 47393
  source 1..299: mol_type = other RNA

SEQ ID NO: 47395 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcattgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47396 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccttgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47397 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactttggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47398 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgttgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47399 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatttggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47400 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatttgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47401 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagttgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47402 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgttggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47403 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagttgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47404 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgttgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47405 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaattggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47406 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagttgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47407 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtttgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47408 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgttggagcacggcagaatagccaagttcagcaaagtgaggaccattaccaccaggtcaaactctataaagcagggcaaagaccagcatttccccgtcttcatgaacgagacgtcggaagagc

SEQ ID NO: 47409 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagttgcacggcagaatagccaagttcagcaaagtgaggaccattaccaccaggtcaaactctataaagcagggcaaagaccagcatttccccgtcttcatgaacgagacgtcggaagagc

SEQ ID NO: 47410 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacttgggcagaatagccaagttcagcaaagtgaggaccattaccaccaggtcaaactctataaagcagggcaaagaccagcatttccccgtcttcatgaacgagacgtcggaagagc

SEQ ID NO: 47411 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcttgagaatagccaagttcagcaaagtgaggaccattaccaccaggtcaaactctataaagcagggcaaagaccagcatttccccgtcttcatgaacgagacgtcggaagagc

SEQ ID NO: 47412 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagattgatagccaagttcagcaaagtgaggaccattaccaccaggtcaaactctataaagcagggcaaagaccagcatttccccgtcttcatgaacgagacgtcggaagagc

SEQ ID NO: 47413 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatattggccaagttcagcaaagtgaggaccattaccaccaggtcaaactctataaagcagggcaaagaccagcatttccccgtcttcatgaacgagacgtcggaagagc

SEQ ID NO: 47414 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccttgaagttcagcaaagtgaggaccattaccaccaggtcaaactctataaagcagggcaaagaccagcatttccccgtcttcatgaacgagacgtcggaagagc

SEQ ID NO: 47415 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttgttcagcaaagtgaggaccattaccaccaggtcaaactctataaagcagggcaaagaccagcatttccccgtcttcatgaacgagacgtcggaagagc

SEQ ID NO: 47416 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcttgagcaaagtgaggaccattaccaccaggtcaaactctataaagcagggcaaagaccagcatttccccgtcttcatgaacgagacgtcggaagagc

SEQ ID NO: 47417 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcttgaaagtgaggaccattaccaccaggtcaaactctataaagcagggcaaagaccagcatttccccgtcttcatgaacgagacgtcggaagagc

SEQ ID NO: 47418 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaattggtgaggaccattaccaccaggtcaaactctataaagcagggcaaagaccagcatttccccgtcttcatgaacgagacgtcggaagagc

SEQ ID NO: 47419 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgttgaggaccattaccaccaggtcaaactctataaagcagggcaaagaccagcatttccccgtcttcatgaacgagacgtcggaagagc

SEQ ID NO: 47420 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggttgaccattaccaccaggtcaaactctataaagcagggcaaagaccagcatttccccgtcttcatgaacgagacgtcggaagagc

SEQ ID NO: 47421 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccttgattaccaccaggtcaaactctataaagcagggcaaagaccagcatttccccgtcttcatgaacgagacgtcggaagagc

SEQ ID NO: 47422 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattttgaccaccaggtcaaactctataaagcagggcaaagaccagcatttccccgtcttcatgaacgagacgtcggaagagc

SEQ ID NO: 47423 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccttgaccaggtcaaactctataaagcagggcaaagaccagcatttccccgtcttcatgaacgagacgtcggaagagc

SEQ ID NO: 47424 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccttgaggtcaaactctataaagcagggcaaagaccagcatttccccgtcttcatgaacgagacgtcggaagagc

SEQ ID NO: 47425 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggttgtcaaactctataaagcagggcaaagaccagcatttccccgtcttcatgaacgagacgtcggaagagc

SEQ ID NO: 47426 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcattgaactctataaagcagggcaaagaccagcatttccccgtcttcatgaacgagacgtcggaagagc

SEQ ID NO: 47427 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacttgtctataaagcagggcaaagaccagcatttccccgtcttcatgaacgagacgtcggaagagc

SEQ ID NO: 47428 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctttgataaagcagggcaaagaccagcatttccccgtcttcatgaacgagacgtcggaagagc

SEQ ID NO: 47429 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatattgaagcagggcaaagaccagcatttccccgtcttcatgaacgagacgtcggaagagc

SEQ ID NO: 47430 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagttgcagggcaaagaccagcatttccccgtcttcatgaacgagacgtcggaagagc

SEQ ID NO: 47431 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagttgggcaaagaccagcatttccccgtcttcatgaacgagacgtcggaagagc

SEQ ID NO: 47432 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcttgaaagaccagcatttccccgtcttcatgaacgagacgtcggaagagc

SEQ ID NO: 47433 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaattggaccagcatttccccgtcttcatgaacgagacgtcggaagagc

SEQ ID NO: 47434 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacttgcagcatttccccgtcttcatgaacgagacgtcggaagagc

SEQ ID NO: 47435 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagttgcatttccccgtcttcatgaacgagacgtcggaagagc

SEQ ID NO: 47436 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttgttccccgtcttcatgaacgagacgtcggaagagc

SEQ ID NO: 47437 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcttgcccgtcttcatgaacgagacgtcggaagagc

SEQ ID NO: 47438 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccttggtcttcatgaacgagacgtcggaagagc

SEQ ID NO: 47439 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttgttcatgaacgagacgtcggaagagc

SEQ ID NO: 47440 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcttgatgaacgagacgtcggaagagc

SEQ ID NO: 47441 - RNA, 299 nt, synthetic construct
  source 1..299: mol_type = other RNA
cgctcttccgcgtctcaagagggacttcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47442 - RNA, 299 nt, synthetic construct
  source 1..299: mol_type = other RNA
cgctcttccgcgtctcaagagggacatcttctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47443 - RNA, 299 nt, synthetic construct
  source 1..299: mol_type = other RNA
cgctcttccgcgtctcaagagggacatctcgttccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47444 - RNA, 299 nt, synthetic construct
  source 1..299: mol_type = other RNA
cgctcttccgcgtctcaagagggacatctcgcgattctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47445 - RNA, 299 nt, synthetic construct
  source 1..299: mol_type = other RNA
cgctcttccgcgtctcaagagggacatctcgcgatttttccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47446 - RNA, 299 nt, synthetic construct
  source 1..299: mol_type = other RNA
cgctcttccgcgtctcaagagggacatctcgcgatttcttttcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47447 - RNA, 299 nt, synthetic construct
  source 1..299: mol_type = other RNA
cgctcttccgcgtctcaagagggacatctcgcgatttcttgagttctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47448 - RNA, 299 nt, synthetic construct
  source 1..299: mol_type = other RNA
cgctcttccgcgtctcaagagggacatctcgcgatttcttgagtctttcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47449 - RNA, 299 nt, synthetic construct
  source 1..299: mol_type = other RNA
cgctcttccgcgtctcaagagggacatctcgcgatttcttgagtctaacttccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47450 - RNA, 299 nt, synthetic construct
  source 1..299: mol_type = other RNA
cgctcttccgcgtctcaagagggacatctcgcgatttcttgagtctaaccccttcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47451 - RNA, 299 nt, synthetic construct
  source 1..299: mol_type = other RNA
cgctcttccgcgtctcaagagggacatctcgcgatttcttgagtctaaccccgtgttcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47452 - RNA, 299 nt, synthetic construct
  source 1..299: mol_type = other RNA
cgctcttccgcgtctcaagagggacatctcgcgatttcttgagtctaaccccgtgatgttcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47453 - RNA, 299 nt, synthetic construct
  source 1..299: mol_type = other RNA
cgctcttccgcgtctcaagagggacatctcgcgatttcttgagtctaaccccgtgatgattttcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47454 - RNA, 299 nt, synthetic construct
  source 1..299: mol_type = other RNA
cgctcttccgcgtctcaagagggacatctcgcgatttcttgagtctaaccccgtgatgattgacttcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47455 - RNA, 299 nt, synthetic construct
  source 1..299: mol_type = other RNA
cgctcttccgcgtctcaagagggacatctcgcgatttcttgagtctaaccccgtgatgattgacgccttcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47456 - RNA, 299 nt, synthetic construct
  source 1..299: mol_type = other RNA
cgctcttccgcgtctcaagagggacatctcgcgatttcttgagtctaaccccgtgatgattgacgccaaattcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47457 - RNA, 299 nt, synthetic construct
  source 1..299: mol_type = other RNA
cgctcttccgcgtctcaagagggacatctcgcgatttcttgagtctaaccccgtgatgattgacgccaaagaattcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47458 - RNA, 299 nt, synthetic construct
  source 1..299: mol_type = other RNA
cgctcttccgcgtctcaagagggacatctcgcgatttcttgagtctaaccccgtgatgattgacgccaaagaagtgttctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47459 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctttcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47460 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctttcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47461 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcattccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47462 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacttcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47463 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggttcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47464 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccttccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47465 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtttctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47466 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47467 - RNA, 299 nt, synthetic construct; identical to SEQ ID NO: 47466
  source 1..299: mol_type = other RNA

SEQ ID NO: 47468 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggttcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47469 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtttcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47470 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacttccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47471 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttttccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47472 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctttcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47473 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcttcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47474 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgttcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47475 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacttcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47476 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggttccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47477 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47478 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgttcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47479 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcattctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47480 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccttcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47481 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactttcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47482 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgttcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47483 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatttcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47484 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatttcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47485 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagttcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47486 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgttcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47487 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagttcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47488 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgttccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47489 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaattcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47490 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagttctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47491 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtttcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47492 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgttcgagcacggcagaatagccaagttcagcaaagtgaggaccattaccaccaggtcaaactctataaagcagggcaaagaccagcatttccccgtcttcatgaacgagacgtcggaagagc

SEQ ID NO: 47493 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagttccacggcagaatagccaagttcagcaaagtgaggaccattaccaccaggtcaaactctataaagcagggcaaagaccagcatttccccgtcttcatgaacgagacgtcggaagagc

SEQ ID NO: 47494 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacttcggcagaatagccaagttcagcaaagtgaggaccattaccaccaggtcaaactctataaagcagggcaaagaccagcatttccccgtcttcatgaacgagacgtcggaagagc

SEQ ID NO: 47495 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcttcagaatagccaagttcagcaaagtgaggaccattaccaccaggtcaaactctataaagcagggcaaagaccagcatttccccgtcttcatgaacgagacgtcggaagagc

SEQ ID NO: 47496 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagattcatagccaagttcagcaaagtgaggaccattaccaccaggtcaaactctataaagcagggcaaagaccagcatttccccgtcttcatgaacgagacgtcggaagagc

SEQ ID NO: 47497 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatattcgccaagttcagcaaagtgaggaccattaccaccaggtcaaactctataaagcagggcaaagaccagcatttccccgtcttcatgaacgagacgtcggaagagc

SEQ ID NO: 47498 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccttcaagttcagcaaagtgaggaccattaccaccaggtcaaactctataaagcagggcaaagaccagcatttccccgtcttcatgaacgagacgtcggaagagc

SEQ ID NO: 47499 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcttcagcaaagtgaggaccattaccaccaggtcaaactctataaagcagggcaaagaccagcatttccccgtcttcatgaacgagacgtcggaagagc

SEQ ID NO: 47500 - RNA, 299 nt, synthetic construct; identical to SEQ ID NO: 47499
  source 1..299: mol_type = other RNA

SEQ ID NO: 47501 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcttcaaagtgaggaccattaccaccaggtcaaactctataaagcagggcaaagaccagcatttccccgtcttcatgaacgagacgtcggaagagc

SEQ ID NO: 47502 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaattcgtgaggaccattaccaccaggtcaaactctataaagcagggcaaagaccagcatttccccgtcttcatgaacgagacgtcggaagagc

SEQ ID NO: 47503 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgttcaggaccattaccaccaggtcaaactctataaagcagggcaaagaccagcatttccccgtcttcatgaacgagacgtcggaagagc

SEQ ID NO: 47504 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggttcaccattaccaccaggtcaaactctataaagcagggcaaagaccagcatttccccgtcttcatgaacgagacgtcggaagagc

SEQ ID NO: 47505 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccttcattaccaccaggtcaaactctataaagcagggcaaagaccagcatttccccgtcttcatgaacgagacgtcggaagagc

SEQ ID NO: 47506 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattttcaccaccaggtcaaactctataaagcagggcaaagaccagcatttccccgtcttcatgaacgagacgtcggaagagc

SEQ ID NO: 47507 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccttcaccaggtcaaactctataaagcagggcaaagaccagcatttccccgtcttcatgaacgagacgtcggaagagc

SEQ ID NO: 47508 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccttcaggtcaaactctataaagcagggcaaagaccagcatttccccgtcttcatgaacgagacgtcggaagagc

SEQ ID NO: 47509 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggttctcaaactctataaagcagggcaaagaccagcatttccccgtcttcatgaacgagacgtcggaagagc

SEQ ID NO: 47510 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcattcaactctataaagcagggcaaagaccagcatttccccgtcttcatgaacgagacgtcggaagagc

SEQ ID NO: 47511 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacttctctataaagcagggcaaagaccagcatttccccgtcttcatgaacgagacgtcggaagagc

SEQ ID NO: 47512 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctttcataaagcagggcaaagaccagcatttccccgtcttcatgaacgagacgtcggaagagc

SEQ ID NO: 47513 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatattcaagcagggcaaagaccagcatttccccgtcttcatgaacgagacgtcggaagagc

SEQ ID NO: 47514 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagttccagggcaaagaccagcatttccccgtcttcatgaacgagacgtcggaagagc

SEQ ID NO: 47515 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagttcggcaaagaccagcatttccccgtcttcatgaacgagacgtcggaagagc

SEQ ID NO: 47516 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcttcaaagaccagcatttccccgtcttcatgaacgagacgtcggaagagc

SEQ ID NO: 47517 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaattcgaccagcatttccccgtcttcatgaacgagacgtcggaagagc

SEQ ID NO: 47518 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacttccagcatttccccgtcttcatgaacgagacgtcggaagagc

SEQ ID NO: 47519 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagttccatttccccgtcttcatgaacgagacgtcggaagagc

SEQ ID NO: 47520 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcttccccgtcttcatgaacgagacgtcggaagagc

SEQ ID NO: 47521 - RNA, 299 nt, synthetic construct; identical to SEQ ID NO: 47520
  source 1..299: mol_type = other RNA

SEQ ID NO: 47522 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccttcgtcttcatgaacgagacgtcggaagagc

SEQ ID NO: 47523 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcttcatgaacgagacgtcggaagagc

SEQ ID NO: 47524 - RNA, 299 nt, synthetic construct; identical to SEQ ID NO: 47523
  source 1..299: mol_type = other RNA

SEQ ID NO: 47525 - RNA, 299 nt, synthetic construct
  source 1..299: mol_type = other RNA
cgctcttccgcgtctcaagagggactggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47526 - RNA, 299 nt, synthetic construct
  source 1..299: mol_type = other RNA
cgctcttccgcgtctcaagagggacatctggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47527 - RNA, 299 nt, synthetic construct
  source 1..299: mol_type = other RNA
cgctcttccgcgtctcaagagggacatctcgtggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47528 - RNA, 299 nt, synthetic construct
  source 1..299: mol_type = other RNA
cgctcttccgcgtctcaagagggacatctcgcgatggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47529 - RNA, 299 nt, synthetic construct
  source 1..299: mol_type = other RNA
cgctcttccgcgtctcaagagggacatctcgcgattttggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47530 - RNA, 299 nt, synthetic construct
  source 1..299: mol_type = other RNA
cgctcttccgcgtctcaagagggacatctcgcgatttctttgggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47531 - RNA, 299 nt, synthetic construct
  source 1..299: mol_type = other RNA
cgctcttccgcgtctcaagagggacatctcgcgatttcttgagtggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47532 - RNA, 299 nt, synthetic construct
  source 1..299: mol_type = other RNA
cgctcttccgcgtctcaagagggacatctcgcgatttcttgagtcttggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47533 - RNA, 299 nt, synthetic construct
  source 1..299: mol_type = other RNA
cgctcttccgcgtctcaagagggacatctcgcgatttcttgagtctaactggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47534 - RNA, 299 nt, synthetic construct
  source 1..299: mol_type = other RNA
cgctcttccgcgtctcaagagggacatctcgcgatttcttgagtctaacccctgggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47535 - RNA, 299 nt, synthetic construct
  source 1..299: mol_type = other RNA
cgctcttccgcgtctcaagagggacatctcgcgatttcttgagtctaaccccgtgtggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47536 - RNA, 299 nt, synthetic construct
  source 1..299: mol_type = other RNA
cgctcttccgcgtctcaagagggacatctcgcgatttcttgagtctaaccccgtgatgtggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47537 - RNA, 299 nt, synthetic construct
  source 1..299: mol_type = other RNA
cgctcttccgcgtctcaagagggacatctcgcgatttcttgagtctaaccccgtgatgatttgggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47538 - RNA, 299 nt, synthetic construct
  source 1..299: mol_type = other RNA
cgctcttccgcgtctcaagagggacatctcgcgatttcttgagtctaaccccgtgatgattgactgggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47539 - RNA, 299 nt, synthetic construct
  source 1..299: mol_type = other RNA
cgctcttccgcgtctcaagagggacatctcgcgatttcttgagtctaaccccgtgatgattgacgcctggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47540 - RNA, 299 nt, synthetic construct
  source 1..299: mol_type = other RNA
cgctcttccgcgtctcaagagggacatctcgcgatttcttgagtctaaccccgtgatgattgacgccaaatgggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47541 - RNA, 299 nt, synthetic construct
  source 1..299: mol_type = other RNA
cgctcttccgcgtctcaagagggacatctcgcgatttcttgagtctaaccccgtgatgattgacgccaaagaatgggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47542 - RNA, 299 nt, synthetic construct
  source 1..299: mol_type = other RNA
cgctcttccgcgtctcaagagggacatctcgcgatttcttgagtctaaccccgtgatgattgacgccaaagaagtgtggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47543 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcttgggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47544 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcttgggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47545 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcatggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47546 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacactggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47547 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggtgggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47548 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcctggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47549 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47550 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttactggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47551 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47552 - RNA, 299 nt, synthetic construct; identical to SEQ ID NO: 47551
  source 1..299: mol_type = other RNA

SEQ ID NO: 47553 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggttggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47554 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaactggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47555 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctttggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47556 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccttggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47557 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47558 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47559 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47560 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47561 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47562 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtgggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47563 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47564 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47565 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttgggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47566 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47567 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattgggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47568 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47569 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47570 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtgggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47571 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47572 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47573 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatgggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47574 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47575 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47576 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtgggagcacggcagaatagccaagttcagcaaagtgaggaccattaccaccaggtcaaactctataaagcagggcaaagaccagcatttccccgtcttcatgaacgagacgtcggaagagc

SEQ ID NO: 47577 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtggcacggcagaatagccaagttcagcaaagtgaggaccattaccaccaggtcaaactctataaagcagggcaaagaccagcatttccccgtcttcatgaacgagacgtcggaagagc

SEQ ID NO: 47578 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactggggcagaatagccaagttcagcaaagtgaggaccattaccaccaggtcaaactctataaagcagggcaaagaccagcatttccccgtcttcatgaacgagacgtcggaagagc

SEQ ID NO: 47579 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctggagaatagccaagttcagcaaagtgaggaccattaccaccaggtcaaactctataaagcagggcaaagaccagcatttccccgtcttcatgaacgagacgtcggaagagc

SEQ ID NO: 47580 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatggatagccaagttcagcaaagtgaggaccattaccaccaggtcaaactctataaagcagggcaaagaccagcatttccccgtcttcatgaacgagacgtcggaagagc

SEQ ID NO: 47581 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatgggccaagttcagcaaagtgaggaccattaccaccaggtcaaactctataaagcagggcaaagaccagcatttccccgtcttcatgaacgagacgtcggaagagc

SEQ ID NO: 47582 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctggaagttcagcaaagtgaggaccattaccaccaggtcaaactctataaagcagggcaaagaccagcatttccccgtcttcatgaacgagacgtcggaagagc

SEQ ID NO: 47583 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtggttcagcaaagtgaggaccattaccaccaggtcaaactctataaagcagggcaaagaccagcatttccccgtcttcatgaacgagacgtcggaagagc

SEQ ID NO: 47584 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctggagcaaagtgaggaccattaccaccaggtcaaactctataaagcagggcaaagaccagcatttccccgtcttcatgaacgagacgtcggaagagc

SEQ ID NO: 47585 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctggaaagtgaggaccattaccaccaggtcaaactctataaagcagggcaaagaccagcatttccccgtcttcatgaacgagacgtcggaagagc

SEQ ID NO: 47586 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatgggtgaggaccattaccaccaggtcaaactctataaagcagggcaaagaccagcatttccccgtcttcatgaacgagacgtcggaagagc

SEQ ID NO: 47587 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtggaggaccattaccaccaggtcaaactctataaagcagggcaaagaccagcatttccccgtcttcatgaacgagacgtcggaagagc

SEQ ID NO: 47588 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtggaccattaccaccaggtcaaactctataaagcagggcaaagaccagcatttccccgtcttcatgaacgagacgtcggaagagc

SEQ ID NO: 47589 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctggattaccaccaggtcaaactctataaagcagggcaaagaccagcatttccccgtcttcatgaacgagacgtcggaagagc

SEQ ID NO: 47590 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttggaccaccaggtcaaactctataaagcagggcaaagaccagcatttccccgtcttcatgaacgagacgtcggaagagc

SEQ ID NO: 47591 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctggaccaggtcaaactctataaagcagggcaaagaccagcatttccccgtcttcatgaacgagacgtcggaagagc

SEQ ID NO: 47592 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctggaggtcaaactctataaagcagggcaaagaccagcatttccccgtcttcatgaacgagacgtcggaagagc

SEQ ID NO: 47593 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtggtcaaactctataaagcagggcaaagaccagcatttccccgtcttcatgaacgagacgtcggaagagc

SEQ ID NO: 47594 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatggaactctataaagcagggcaaagaccagcatttccccgtcttcatgaacgagacgtcggaagagc

SEQ ID NO: 47595 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactggtctataaagcagggcaaagaccagcatttccccgtcttcatgaacgagacgtcggaagagc

SEQ ID NO: 47596 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttggataaagcagggcaaagaccagcatttccccgtcttcatgaacgagacgtcggaagagc

SEQ ID NO: 47597 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatggaagcagggcaaagaccagcatttccccgtcttcatgaacgagacgtcggaagagc

SEQ ID NO: 47598 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtggcagggcaaagaccagcatttccccgtcttcatgaacgagacgtcggaagagc

SEQ ID NO: 47599 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtggggcaaagaccagcatttccccgtcttcatgaacgagacgtcggaagagc

SEQ ID NO: 47600 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctggaaagaccagcatttccccgtcttcatgaacgagacgtcggaagagc

SEQ ID NO: 47601 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatgggaccagcatttccccgtcttcatgaacgagacgtcggaagagc

SEQ ID NO: 47602 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactggcagcatttccccgtcttcatgaacgagacgtcggaagagc

SEQ ID NO: 47603 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtggcatttccccgtcttcatgaacgagacgtcggaagagc

SEQ ID NO: 47604 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattggttccccgtcttcatgaacgagacgtcggaagagc

SEQ ID NO: 47605 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctggcccgtcttcatgaacgagacgtcggaagagc

SEQ ID NO: 47606 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctgggtcttcatgaacgagacgtcggaagagc

SEQ ID NO: 47607 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctggttcatgaacgagacgtcggaagagc

SEQ ID NO: 47608 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttctggatgaacgagacgtcggaagagc

SEQ ID NO: 47609 - RNA, 299 nt, synthetic construct
  source 1..299: mol_type = other RNA
cgctcttccgcgtctcaagagggactgcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47610 - RNA, 299 nt, synthetic construct
  source 1..299: mol_type = other RNA
cgctcttccgcgtctcaagagggacatctgctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47611 - RNA, 299 nt, synthetic construct
  source 1..299: mol_type = other RNA
cgctcttccgcgtctcaagagggacatctcgtgccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47612 - RNA, 299 nt, synthetic construct
  source 1..299: mol_type = other RNA
cgctcttccgcgtctcaagagggacatctcgcgatgctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47613 - RNA, 299 nt, synthetic construct
  source 1..299: mol_type = other RNA
cgctcttccgcgtctcaagagggacatctcgcgattttgccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47614 - RNA, 299 nt, synthetic construct
  source 1..299: mol_type = other RNA
cgctcttccgcgtctcaagagggacatctcgcgatttctttgcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47615 - RNA, 299 nt, synthetic construct
  source 1..299: mol_type = other RNA
cgctcttccgcgtctcaagagggacatctcgcgatttcttgagtgctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47616 - RNA, 299 nt, synthetic construct
  source 1..299: mol_type = other RNA
cgctcttccgcgtctcaagagggacatctcgcgatttcttgagtcttgcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47617 - RNA, 299 nt, synthetic construct
  source 1..299: mol_type = other RNA
cgctcttccgcgtctcaagagggacatctcgcgatttcttgagtctaactgccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47618 - RNA, 299 nt, synthetic construct
  source 1..299: mol_type = other RNA
cgctcttccgcgtctcaagagggacatctcgcgatttcttgagtctaacccctgcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47619 - RNA, 299 nt, synthetic construct
  source 1..299: mol_type = other RNA
cgctcttccgcgtctcaagagggacatctcgcgatttcttgagtctaaccccgtgtgcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47620 - RNA, 299 nt, synthetic construct
  source 1..299: mol_type = other RNA
cgctcttccgcgtctcaagagggacatctcgcgatttcttgagtctaaccccgtgatgtgcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47621 - RNA, 299 nt, synthetic construct
  source 1..299: mol_type = other RNA
cgctcttccgcgtctcaagagggacatctcgcgatttcttgagtctaaccccgtgatgatttgcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47622 - RNA, 299 nt, synthetic construct
  source 1..299: mol_type = other RNA
cgctcttccgcgtctcaagagggacatctcgcgatttcttgagtctaaccccgtgatgattgactgcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47623 - RNA, 299 nt, synthetic construct
  source 1..299: mol_type = other RNA
cgctcttccgcgtctcaagagggacatctcgcgatttcttgagtctaaccccgtgatgattgacgcctgcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47624 - RNA, 299 nt, synthetic construct
  source 1..299: mol_type = other RNA
cgctcttccgcgtctcaagagggacatctcgcgatttcttgagtctaaccccgtgatgattgacgccaaatgcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47625 - RNA, 299 nt, synthetic construct
  source 1..299: mol_type = other RNA
cgctcttccgcgtctcaagagggacatctcgcgatttcttgagtctaaccccgtgatgattgacgccaaagaatgcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47626 - RNA, 299 nt, synthetic construct
  source 1..299: mol_type = other RNA
cgctcttccgcgtctcaagagggacatctcgcgatttcttgagtctaaccccgtgatgattgacgccaaagaagtgtgctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47627 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcttgcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47628 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcttgcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47629 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcatgccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47630 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacactgcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47631 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggtgcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47632 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcctgccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47633 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttgctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47634 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttactgcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47635 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47636 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggtgcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47637 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggttgcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47638 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaactgccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47639 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctttgccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47640 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccttgcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47641 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctgcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47642 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtgcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47643 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactgcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47644 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtgccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47645 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttgcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47646 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtgcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47647 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatgctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47648 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctgcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47649 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttgcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47650 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtgcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47651 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattgcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47652 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattgcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47653 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtgcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47654 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtgcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47655 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtgcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47656 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtgccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47657 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatgcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47658 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47659 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttgcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47660 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtgcgagcacggcagaatagccaagttcagcaaagtgaggaccattaccaccaggtcaaactctataaagcagggcaaagaccagcatttccccgtcttcatgaacgagacgtcggaagagc

SEQ ID NO: 47661 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtgccacggcagaatagccaagttcagcaaagtgaggaccattaccaccaggtcaaactctataaagcagggcaaagaccagcatttccccgtcttcatgaacgagacgtcggaagagc

SEQ ID NO: 47662 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactgcggcagaatagccaagttcagcaaagtgaggaccattaccaccaggtcaaactctataaagcagggcaaagaccagcatttccccgtcttcatgaacgagacgtcggaagagc

SEQ ID NO: 47663 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctgcagaatagccaagttcagcaaagtgaggaccattaccaccaggtcaaactctataaagcagggcaaagaccagcatttccccgtcttcatgaacgagacgtcggaagagc

SEQ ID NO: 47664 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatgcatagccaagttcagcaaagtgaggaccattaccaccaggtcaaactctataaagcagggcaaagaccagcatttccccgtcttcatgaacgagacgtcggaagagc

SEQ ID NO: 47665 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatgcgccaagttcagcaaagtgaggaccattaccaccaggtcaaactctataaagcagggcaaagaccagcatttccccgtcttcatgaacgagacgtcggaagagc

SEQ ID NO: 47666 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctgcaagttcagcaaagtgaggaccattaccaccaggtcaaactctataaagcagggcaaagaccagcatttccccgtcttcatgaacgagacgtcggaagagc

SEQ ID NO: 47667 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtgcttcagcaaagtgaggaccattaccaccaggtcaaactctataaagcagggcaaagaccagcatttccccgtcttcatgaacgagacgtcggaagagc

SEQ ID NO: 47668 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctgcagcaaagtgaggaccattaccaccaggtcaaactctataaagcagggcaaagaccagcatttccccgtcttcatgaacgagacgtcggaagagc

SEQ ID NO: 47669 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctgcaaagtgaggaccattaccaccaggtcaaactctataaagcagggcaaagaccagcatttccccgtcttcatgaacgagacgtcggaagagc

SEQ ID NO: 47670 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatgcgtgaggaccattaccaccaggtcaaactctataaagcagggcaaagaccagcatttccccgtcttcatgaacgagacgtcggaagagc

SEQ ID NO: 47671 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtgcaggaccattaccaccaggtcaaactctataaagcagggcaaagaccagcatttccccgtcttcatgaacgagacgtcggaagagc

SEQ ID NO: 47672 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtgcaccattaccaccaggtcaaactctataaagcagggcaaagaccagcatttccccgtcttcatgaacgagacgtcggaagagc

SEQ ID NO: 47673 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctgcattaccaccaggtcaaactctataaagcagggcaaagaccagcatttccccgtcttcatgaacgagacgtcggaagagc

SEQ ID NO: 47674 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttgcaccaccaggtcaaactctataaagcagggcaaagaccagcatttccccgtcttcatgaacgagacgtcggaagagc

SEQ ID NO: 47675 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctgcaccaggtcaaactctataaagcagggcaaagaccagcatttccccgtcttcatgaacgagacgtcggaagagc

SEQ ID NO: 47676 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctgcaggtcaaactctataaagcagggcaaagaccagcatttccccgtcttcatgaacgagacgtcggaagagc

SEQ ID NO: 47677 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtgctcaaactctataaagcagggcaaagaccagcatttccccgtcttcatgaacgagacgtcggaagagc

SEQ ID NO: 47678 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatgcaactctataaagcagggcaaagaccagcatttccccgtcttcatgaacgagacgtcggaagagc

SEQ ID NO: 47679 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactgctctataaagcagggcaaagaccagcatttccccgtcttcatgaacgagacgtcggaagagc

SEQ ID NO: 47680 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttgcataaagcagggcaaagaccagcatttccccgtcttcatgaacgagacgtcggaagagc

SEQ ID NO: 47681 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatgcaagcagggcaaagaccagcatttccccgtcttcatgaacgagacgtcggaagagc

SEQ ID NO: 47682 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtgccagggcaaagaccagcatttccccgtcttcatgaacgagacgtcggaagagc

SEQ ID NO: 47683 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtgcggcaaagaccagcatttccccgtcttcatgaacgagacgtcggaagagc

SEQ ID NO: 47684 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctgcaaagaccagcatttccccgtcttcatgaacgagacgtcggaagagc

SEQ ID NO: 47685 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatgcgaccagcatttccccgtcttcatgaacgagacgtcggaagagc

SEQ ID NO: 47686 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactgccagcatttccccgtcttcatgaacgagacgtcggaagagc

SEQ ID NO: 47687 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtgccatttccccgtcttcatgaacgagacgtcggaagagc

SEQ ID NO: 47688 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattgcttccccgtcttcatgaacgagacgtcggaagagc

SEQ ID NO: 47689 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctgccccgtcttcatgaacgagacgtcggaagagc

SEQ ID NO: 47690 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctgcgtcttcatgaacgagacgtcggaagagc

SEQ ID NO: 47691 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctgcttcatgaacgagacgtcggaagagc

SEQ ID NO: 47692 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttctgcatgaacgagacgtcggaagagc

SEQ ID NO: 47693 - RNA, 299 nt, synthetic construct
  source 1..299: mol_type = other RNA
cgctcttccgcgtctcaagagggactcgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47694 - RNA, 299 nt, synthetic construct
  source 1..299: mol_type = other RNA
cgctcttccgcgtctcaagagggacatctcgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47695 - RNA, 299 nt, synthetic construct; identical to SEQ ID NO: 47694
  source 1..299: mol_type = other RNA

SEQ ID NO: 47696 - RNA, 299 nt, synthetic construct
  source 1..299: mol_type = other RNA
cgctcttccgcgtctcaagagggacatctcgcgatcgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47697 - RNA, 299 nt, synthetic construct
  source 1..299: mol_type = other RNA
cgctcttccgcgtctcaagagggacatctcgcgattttcgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47698 - RNA, 299 nt, synthetic construct
  source 1..299: mol_type = other RNA
cgctcttccgcgtctcaagagggacatctcgcgatttctttcggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47699 - RNA, 299 nt, synthetic construct
  source 1..299: mol_type = other RNA
cgctcttccgcgtctcaagagggacatctcgcgatttcttgagtcgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47700 - RNA, 299 nt, synthetic construct
  source 1..299: mol_type = other RNA
cgctcttccgcgtctcaagagggacatctcgcgatttcttgagtcttcgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47701 - RNA, 299 nt, synthetic construct
  source 1..299: mol_type = other RNA
cgctcttccgcgtctcaagagggacatctcgcgatttcttgagtctaactcgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47702 - RNA, 299 nt, synthetic construct
  source 1..299: mol_type = other RNA
cgctcttccgcgtctcaagagggacatctcgcgatttcttgagtctaacccctcggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47703 - RNA, 299 nt, synthetic construct
  source 1..299: mol_type = other RNA
cgctcttccgcgtctcaagagggacatctcgcgatttcttgagtctaaccccgtgtcgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47704 - RNA, 299 nt, synthetic construct
  source 1..299: mol_type = other RNA
cgctcttccgcgtctcaagagggacatctcgcgatttcttgagtctaaccccgtgatgtcgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47705 - RNA, 299 nt, synthetic construct
  source 1..299: mol_type = other RNA
cgctcttccgcgtctcaagagggacatctcgcgatttcttgagtctaaccccgtgatgatttcggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47706 - RNA, 299 nt, synthetic construct
  source 1..299: mol_type = other RNA
cgctcttccgcgtctcaagagggacatctcgcgatttcttgagtctaaccccgtgatgattgactcggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47707 - RNA, 299 nt, synthetic construct
  source 1..299: mol_type = other RNA
cgctcttccgcgtctcaagagggacatctcgcgatttcttgagtctaaccccgtgatgattgacgcctcgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47708 - RNA, 299 nt, synthetic construct
  source 1..299: mol_type = other RNA
cgctcttccgcgtctcaagagggacatctcgcgatttcttgagtctaaccccgtgatgattgacgccaaatcggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47709 - RNA, 299 nt, synthetic construct
  source 1..299: mol_type = other RNA
cgctcttccgcgtctcaagagggacatctcgcgatttcttgagtctaaccccgtgatgattgacgccaaagaatcggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47710 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47711 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcttcggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47712 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcttcggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47713 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcatcgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47714 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacactcgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47715 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggtcggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47716 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcctcgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47717 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttcgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47718 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttactcgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47719 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctcgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47720 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggtcgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47721 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggttcgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47722 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaactcgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47723 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctttcgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47724 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccttcgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47725 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctcgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47726 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtcgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47727 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactcgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47728 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtcgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47729 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttcgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47730 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtcggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47731 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47732 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctcgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47733 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttcggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47734 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtcgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47735 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattcggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47736 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattcgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47737 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtcgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47738 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtcggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47739 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtcgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47740 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtcgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47741 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatcggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47742 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtcgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47743 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttcgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47744 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtcggagcacggcagaatagccaagttcagcaaagtgaggaccattaccaccaggtcaaactctataaagcagggcaaagaccagcatttccccgtcttcatgaacgagacgtcggaagagc

SEQ ID NO: 47745 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtcgcacggcagaatagccaagttcagcaaagtgaggaccattaccaccaggtcaaactctataaagcagggcaaagaccagcatttccccgtcttcatgaacgagacgtcggaagagc

SEQ ID NO: 47746 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactcgggcagaatagccaagttcagcaaagtgaggaccattaccaccaggtcaaactctataaagcagggcaaagaccagcatttccccgtcttcatgaacgagacgtcggaagagc

SEQ ID NO: 47747 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctcgagaatagccaagttcagcaaagtgaggaccattaccaccaggtcaaactctataaagcagggcaaagaccagcatttccccgtcttcatgaacgagacgtcggaagagc

SEQ ID NO: 47748 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatcgatagccaagttcagcaaagtgaggaccattaccaccaggtcaaactctataaagcagggcaaagaccagcatttccccgtcttcatgaacgagacgtcggaagagc

SEQ ID NO: 47749 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatcggccaagttcagcaaagtgaggaccattaccaccaggtcaaactctataaagcagggcaaagaccagcatttccccgtcttcatgaacgagacgtcggaagagc

SEQ ID NO: 47750 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctcgaagttcagcaaagtgaggaccattaccaccaggtcaaactctataaagcagggcaaagaccagcatttccccgtcttcatgaacgagacgtcggaagagc

SEQ ID NO: 47751 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtcgttcagcaaagtgaggaccattaccaccaggtcaaactctataaagcagggcaaagaccagcatttccccgtcttcatgaacgagacgtcggaagagc

SEQ ID NO: 47752 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctcgagcaaagtgaggaccattaccaccaggtcaaactctataaagcagggcaaagaccagcatttccccgtcttcatgaacgagacgtcggaagagc

SEQ ID NO: 47753 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctcgaaagtgaggaccattaccaccaggtcaaactctataaagcagggcaaagaccagcatttccccgtcttcatgaacgagacgtcggaagagc

SEQ ID NO: 47754 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatcggtgaggaccattaccaccaggtcaaactctataaagcagggcaaagaccagcatttccccgtcttcatgaacgagacgtcggaagagc

SEQ ID NO: 47755 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtcgaggaccattaccaccaggtcaaactctataaagcagggcaaagaccagcatttccccgtcttcatgaacgagacgtcggaagagc

SEQ ID NO: 47756 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtcgaccattaccaccaggtcaaactctataaagcagggcaaagaccagcatttccccgtcttcatgaacgagacgtcggaagagc

SEQ ID NO: 47757 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctcgattaccaccaggtcaaactctataaagcagggcaaagaccagcatttccccgtcttcatgaacgagacgtcggaagagc

SEQ ID NO: 47758 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttcgaccaccaggtcaaactctataaagcagggcaaagaccagcatttccccgtcttcatgaacgagacgtcggaagagc

SEQ ID NO: 47759 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctcgaccaggtcaaactctataaagcagggcaaagaccagcatttccccgtcttcatgaacgagacgtcggaagagc

SEQ ID NO: 47760 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctcgaggtcaaactctataaagcagggcaaagaccagcatttccccgtcttcatgaacgagacgtcggaagagc

SEQ ID NO: 47761 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcgtcaaactctataaagcagggcaaagaccagcatttccccgtcttcatgaacgagacgtcggaagagc

SEQ ID NO: 47762 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatcgaactctataaagcagggcaaagaccagcatttccccgtcttcatgaacgagacgtcggaagagc

SEQ ID NO: 47763 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcgtctataaagcagggcaaagaccagcatttccccgtcttcatgaacgagacgtcggaagagc

SEQ ID NO: 47764 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttcgataaagcagggcaaagaccagcatttccccgtcttcatgaacgagacgtcggaagagc

SEQ ID NO: 47765 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatcgaagcagggcaaagaccagcatttccccgtcttcatgaacgagacgtcggaagagc

SEQ ID NO: 47766 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtcgcagggcaaagaccagcatttccccgtcttcatgaacgagacgtcggaagagc

SEQ ID NO: 47767 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtcgggcaaagaccagcatttccccgtcttcatgaacgagacgtcggaagagc

SEQ ID NO: 47768 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctcgaaagaccagcatttccccgtcttcatgaacgagacgtcggaagagc

SEQ ID NO: 47769 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatcggaccagcatttccccgtcttcatgaacgagacgtcggaagagc

SEQ ID NO: 47770 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactcgcagcatttccccgtcttcatgaacgagacgtcggaagagc

SEQ ID NO: 47771 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtcgcatttccccgtcttcatgaacgagacgtcggaagagc

SEQ ID NO: 47772 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattcgttccccgtcttcatgaacgagacgtcggaagagc

SEQ ID NO: 47773 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctcgcccgtcttcatgaacgagacgtcggaagagc

SEQ ID NO: 47774 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctcggtcttcatgaacgagacgtcggaagagc

SEQ ID NO: 47775 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctcgttcatgaacgagacgtcggaagagc

SEQ ID NO: 47776 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttctcgatgaacgagacgtcggaagagc

SEQ ID NO: 47777 - RNA, 299 nt, synthetic construct
  source 1..299: mol_type = other RNA
cgctcttccgcgtctcaagagggactccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47778 - RNA, 299 nt, synthetic construct
  source 1..299: mol_type = other RNA
cgctcttccgcgtctcaagagggacatctcctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47779 - RNA, 299 nt, synthetic construct
  source 1..299: mol_type = other RNA
cgctcttccgcgtctcaagagggacatctcgtcccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47780 - RNA, 299 nt, synthetic construct
  source 1..299: mol_type = other RNA
cgctcttccgcgtctcaagagggacatctcgcgatcctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47781 - RNA, 299 nt, synthetic construct
  source 1..299: mol_type = other RNA
cgctcttccgcgtctcaagagggacatctcgcgattttcccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47782 - RNA, 299 nt, synthetic construct
  source 1..299: mol_type = other RNA
cgctcttccgcgtctcaagagggacatctcgcgatttctttccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47783 - RNA, 299 nt, synthetic construct
  source 1..299: mol_type = other RNA
cgctcttccgcgtctcaagagggacatctcgcgatttcttgagtcctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47784 - RNA, 299 nt, synthetic construct
  source 1..299: mol_type = other RNA
cgctcttccgcgtctcaagagggacatctcgcgatttcttgagtcttccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47785 - RNA, 299 nt, synthetic construct
  source 1..299: mol_type = other RNA
cgctcttccgcgtctcaagagggacatctcgcgatttcttgagtctaactcccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47786 - RNA, 299 nt, synthetic construct
  source 1..299: mol_type = other RNA
cgctcttccgcgtctcaagagggacatctcgcgatttcttgagtctaacccctccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47787 - RNA, 299 nt, synthetic construct
  source 1..299: mol_type = other RNA
cgctcttccgcgtctcaagagggacatctcgcgatttcttgagtctaaccccgtgtccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47788 - RNA, 299 nt, synthetic construct
  source 1..299: mol_type = other RNA
cgctcttccgcgtctcaagagggacatctcgcgatttcttgagtctaaccccgtgatgtccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47789 - RNA, 299 nt, synthetic construct
  source 1..299: mol_type = other RNA
cgctcttccgcgtctcaagagggacatctcgcgatttcttgagtctaaccccgtgatgatttccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47790 - RNA, 299 nt, synthetic construct
  source 1..299: mol_type = other RNA
cgctcttccgcgtctcaagagggacatctcgcgatttcttgagtctaaccccgtgatgattgactccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47791 - RNA, 299 nt, synthetic construct
  source 1..299: mol_type = other RNA
cgctcttccgcgtctcaagagggacatctcgcgatttcttgagtctaaccccgtgatgattgacgcctccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47792 - RNA, 299 nt, synthetic construct
  source 1..299: mol_type = other RNA
cgctcttccgcgtctcaagagggacatctcgcgatttcttgagtctaaccccgtgatgattgacgccaaatccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47793 - RNA, 299 nt, synthetic construct
  source 1..299: mol_type = other RNA
cgctcttccgcgtctcaagagggacatctcgcgatttcttgagtctaaccccgtgatgattgacgccaaagaatccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47794 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47795 - RNA, 299 nt, synthetic construct
  source 1..299: mol_type = other RNA
cgctcttccgcgtctcaagagggacatctcgcgatttcttgagtctaaccccgtgatgattgacgccaaagaagtgtcttccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47796 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcttccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47797 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcatcccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47798 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacactccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47799 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggtccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47800 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcctcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47801 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttcctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47802 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttactccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47803 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctcctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47804 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggtccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47805 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggttccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47806 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaactcccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47807 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctttcccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47808 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccttccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47809 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47810 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47811 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47812 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtcccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47813 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47814 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47815 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47816 - RNA, 299 nt, synthetic construct; identical to SEQ ID NO: 47815
  source 1..299: mol_type = other RNA

SEQ ID NO: 47817 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47818 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47819 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47820 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47821 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47822 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47823 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47824 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtcccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47825 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47826 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtcctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47827 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47828 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtccgagcacggcagaatagccaagttcagcaaagtgaggaccattaccaccaggtcaaactctataaagcagggcaaagaccagcatttccccgtcttcatgaacgagacgtcggaagagc

SEQ ID NO: 47829 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtcccacggcagaatagccaagttcagcaaagtgaggaccattaccaccaggtcaaactctataaagcagggcaaagaccagcatttccccgtcttcatgaacgagacgtcggaagagc

SEQ ID NO: 47830 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactccggcagaatagccaagttcagcaaagtgaggaccattaccaccaggtcaaactctataaagcagggcaaagaccagcatttccccgtcttcatgaacgagacgtcggaagagc

SEQ ID NO: 47831 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctccagaatagccaagttcagcaaagtgaggaccattaccaccaggtcaaactctataaagcagggcaaagaccagcatttccccgtcttcatgaacgagacgtcggaagagc

SEQ ID NO: 47832 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatccatagccaagttcagcaaagtgaggaccattaccaccaggtcaaactctataaagcagggcaaagaccagcatttccccgtcttcatgaacgagacgtcggaagagc

SEQ ID NO: 47833 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatccgccaagttcagcaaagtgaggaccattaccaccaggtcaaactctataaagcagggcaaagaccagcatttccccgtcttcatgaacgagacgtcggaagagc

SEQ ID NO: 47834 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctccaagttcagcaaagtgaggaccattaccaccaggtcaaactctataaagcagggcaaagaccagcatttccccgtcttcatgaacgagacgtcggaagagc

SEQ ID NO: 47835 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtccttcagcaaagtgaggaccattaccaccaggtcaaactctataaagcagggcaaagaccagcatttccccgtcttcatgaacgagacgtcggaagagc

SEQ ID NO: 47836 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctccagcaaagtgaggaccattaccaccaggtcaaactctataaagcagggcaaagaccagcatttccccgtcttcatgaacgagacgtcggaagagc

SEQ ID NO: 47837 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctccaaagtgaggaccattaccaccaggtcaaactctataaagcagggcaaagaccagcatttccccgtcttcatgaacgagacgtcggaagagc

SEQ ID NO: 47838 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatccgtgaggaccattaccaccaggtcaaactctataaagcagggcaaagaccagcatttccccgtcttcatgaacgagacgtcggaagagc

SEQ ID NO: 47839 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtccaggaccattaccaccaggtcaaactctataaagcagggcaaagaccagcatttccccgtcttcatgaacgagacgtcggaagagc

SEQ ID NO: 47840 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtccaccattaccaccaggtcaaactctataaagcagggcaaagaccagcatttccccgtcttcatgaacgagacgtcggaagagc

SEQ ID NO: 47841 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctccattaccaccaggtcaaactctataaagcagggcaaagaccagcatttccccgtcttcatgaacgagacgtcggaagagc

SEQ ID NO: 47842 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttccaccaccaggtcaaactctataaagcagggcaaagaccagcatttccccgtcttcatgaacgagacgtcggaagagc

SEQ ID NO: 47843 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctccaccaggtcaaactctataaagcagggcaaagaccagcatttccccgtcttcatgaacgagacgtcggaagagc

SEQ ID NO: 47844 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctccaggtcaaactctataaagcagggcaaagaccagcatttccccgtcttcatgaacgagacgtcggaagagc

SEQ ID NO: 47845 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcctcaaactctataaagcagggcaaagaccagcatttccccgtcttcatgaacgagacgtcggaagagc

SEQ ID NO: 47846 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatccaactctataaagcagggcaaagaccagcatttccccgtcttcatgaacgagacgtcggaagagc

SEQ ID NO: 47847 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcctctataaagcagggcaaagaccagcatttccccgtcttcatgaacgagacgtcggaagagc

SEQ ID NO: 47848 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttccataaagcagggcaaagaccagcatttccccgtcttcatgaacgagacgtcggaagagc

SEQ ID NO: 47849 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatccaagcagggcaaagaccagcatttccccgtcttcatgaacgagacgtcggaagagc

SEQ ID NO: 47850 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtcccagggcaaagaccagcatttccccgtcttcatgaacgagacgtcggaagagc

SEQ ID NO: 47851 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtccggcaaagaccagcatttccccgtcttcatgaacgagacgtcggaagagc

SEQ ID NO: 47852 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctccaaagaccagcatttccccgtcttcatgaacgagacgtcggaagagc

SEQ ID NO: 47853 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatccgaccagcatttccccgtcttcatgaacgagacgtcggaagagc

SEQ ID NO: 47854 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactcccagcatttccccgtcttcatgaacgagacgtcggaagagc

SEQ ID NO: 47855 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtcccatttccccgtcttcatgaacgagacgtcggaagagc

SEQ ID NO: 47856 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattccttccccgtcttcatgaacgagacgtcggaagagc

SEQ ID NO: 47857 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctcccccgtcttcatgaacgagacgtcggaagagc

SEQ ID NO: 47858 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctccgtcttcatgaacgagacgtcggaagagc

SEQ ID NO: 47859 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctccttcatgaacgagacgtcggaagagc

SEQ ID NO: 47860 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttctccatgaacgagacgtcggaagagc

SEQ ID NO: 47861 - RNA, 299 nt, synthetic construct
  source 1..299: mol_type = other RNA
cgctcttccgcgtctcaagagggacgagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47862 - RNA, 299 nt, synthetic construct
  source 1..299: mol_type = other RNA
cgctcttccgcgtctcaagagggacatcgagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47863 - RNA, 299 nt, synthetic construct
  source 1..299: mol_type = other RNA
cgctcttccgcgtctcaagagggacatctcggagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47864 - RNA, 299 nt, synthetic construct
  source 1..299: mol_type = other RNA
cgctcttccgcgtctcaagagggacatctcgcgagagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47865 - RNA, 299 nt, synthetic construct
  source 1..299: mol_type = other RNA
cgctcttccgcgtctcaagagggacatctcgcgatttgagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47866 - RNA, 299 nt, synthetic construct
  source 1..299: mol_type = other RNA
cgctcttccgcgtctcaagagggacatctcgcgatttcttgaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47867 - RNA, 299 nt, synthetic construct; identical to SEQ ID NO: 47866
  source 1..299: mol_type = other RNA

SEQ ID NO: 47868 - RNA, 299 nt, synthetic construct
  source 1..299: mol_type = other RNA
cgctcttccgcgtctcaagagggacatctcgcgatttcttgagtctgagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47869 - RNA, 299 nt, synthetic construct
  source 1..299: mol_type = other RNA
cgctcttccgcgtctcaagagggacatctcgcgatttcttgagtctaacgagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47870 - RNA, 299 nt, synthetic construct
  source 1..299: mol_type = other RNA
cgctcttccgcgtctcaagagggacatctcgcgatttcttgagtctaaccccgaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47871 - RNA, 299 nt, synthetic construct
  source 1..299: mol_type = other RNA
cgctcttccgcgtctcaagagggacatctcgcgatttcttgagtctaaccccgtggagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47872 - RNA, 299 nt, synthetic construct
  source 1..299: mol_type = other RNA
cgctcttccgcgtctcaagagggacatctcgcgatttcttgagtctaaccccgtgatggagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47873 - RNA, 299 nt, synthetic construct
  source 1..299: mol_type = other RNA
cgctcttccgcgtctcaagagggacatctcgcgatttcttgagtctaaccccgtgatgattgaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47874 - RNA, 299 nt, synthetic construct
  source 1..299: mol_type = other RNA
cgctcttccgcgtctcaagagggacatctcgcgatttcttgagtctaaccccgtgatgattgacgaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47875 - RNA, 299 nt, synthetic construct
  source 1..299: mol_type = other RNA
cgctcttccgcgtctcaagagggacatctcgcgatttcttgagtctaaccccgtgatgattgacgccgagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47876 - RNA, 299 nt, synthetic construct
  source 1..299: mol_type = other RNA
cgctcttccgcgtctcaagagggacatctcgcgatttcttgagtctaaccccgtgatgattgacgccaaagaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47877 - RNA, 299 nt, synthetic construct
  source 1..299: mol_type = other RNA
cgctcttccgcgtctcaagagggacatctcgcgatttcttgagtctaaccccgtgatgattgacgccaaagaagaggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47878 - RNA, 299 nt, synthetic construct
  source 1..299: mol_type = other RNA
cgctcttccgcgtctcaagagggacatctcgcgatttcttgagtctaaccccgtgatgattgacgccaaagaagtggagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47879 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47880 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47881 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47882 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47883 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47884 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47885 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47886 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47887 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47888 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47889 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47890 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47891 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47892 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47893 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47894 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47895 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47896 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47897 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47898 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47899 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47900 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47901 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47902 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47903 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47904 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47905 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47906 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47907 - RNA, 299 nt, synthetic construct; identical to SEQ ID NO: 47906
  source 1..299: mol_type = other RNA

SEQ ID NO: 47908 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47909 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47910 - RNA, 299 nt, synthetic construct; identical to SEQ ID NO: 47909
  source 1..299: mol_type = other RNA

SEQ ID NO: 47911 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47912 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggagcacggcagaatagccaagttcagcaaagtgaggaccattaccaccaggtcaaactctataaagcagggcaaagaccagcatttccccgtcttcatgaacgagacgtcggaagagc

SEQ ID NO: 47913 - RNA, 299 nt, synthetic construct; identical to SEQ ID NO: 47912
  source 1..299: mol_type = other RNA

SEQ ID NO: 47914 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgagggcagaatagccaagttcagcaaagtgaggaccattaccaccaggtcaaactctataaagcagggcaaagaccagcatttccccgtcttcatgaacgagacgtcggaagagc

SEQ ID NO: 47915 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgagagaatagccaagttcagcaaagtgaggaccattaccaccaggtcaaactctataaagcagggcaaagaccagcatttccccgtcttcatgaacgagacgtcggaagagc

SEQ ID NO: 47916 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagagatagccaagttcagcaaagtgaggaccattaccaccaggtcaaactctataaagcagggcaaagaccagcatttccccgtcttcatgaacgagacgtcggaagagc

SEQ ID NO: 47917 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagaggccaagttcagcaaagtgaggaccattaccaccaggtcaaactctataaagcagggcaaagaccagcatttccccgtcttcatgaacgagacgtcggaagagc

SEQ ID NO: 47918 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgagaagttcagcaaagtgaggaccattaccaccaggtcaaactctataaagcagggcaaagaccagcatttccccgtcttcatgaacgagacgtcggaagagc

SEQ ID NO: 47919 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggagttcagcaaagtgaggaccattaccaccaggtcaaactctataaagcagggcaaagaccagcatttccccgtcttcatgaacgagacgtcggaagagc

SEQ ID NO: 47920 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgagagcaaagtgaggaccattaccaccaggtcaaactctataaagcagggcaaagaccagcatttccccgtcttcatgaacgagacgtcggaagagc

SEQ ID NO: 47921 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgagaaagtgaggaccattaccaccaggtcaaactctataaagcagggcaaagaccagcatttccccgtcttcatgaacgagacgtcggaagagc

SEQ ID NO: 47922 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagaggtgaggaccattaccaccaggtcaaactctataaagcagggcaaagaccagcatttccccgtcttcatgaacgagacgtcggaagagc

SEQ ID NO: 47923 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggagaggaccattaccaccaggtcaaactctataaagcagggcaaagaccagcatttccccgtcttcatgaacgagacgtcggaagagc

SEQ ID NO: 47924 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggagaccattaccaccaggtcaaactctataaagcagggcaaagaccagcatttccccgtcttcatgaacgagacgtcggaagagc

SEQ ID NO: 47925 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgagattaccaccaggtcaaactctataaagcagggcaaagaccagcatttccccgtcttcatgaacgagacgtcggaagagc

SEQ ID NO: 47926 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgagaccaccaggtcaaactctataaagcagggcaaagaccagcatttccccgtcttcatgaacgagacgtcggaagagc

SEQ ID NO: 47927 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgagaccaggtcaaactctataaagcagggcaaagaccagcatttccccgtcttcatgaacgagacgtcggaagagc

SEQ ID NO: 47928 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgagaggtcaaactctataaagcagggcaaagaccagcatttccccgtcttcatgaacgagacgtcggaagagc

SEQ ID NO: 47929 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggagtcaaactctataaagcagggcaaagaccagcatttccccgtcttcatgaacgagacgtcggaagagc

SEQ ID NO: 47930 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagagaactctataaagcagggcaaagaccagcatttccccgtcttcatgaacgagacgtcggaagagc

SEQ ID NO: 47931 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgagtctataaagcagggcaaagaccagcatttccccgtcttcatgaacgagacgtcggaagagc

SEQ ID NO: 47932 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgagataaagcagggcaaagaccagcatttccccgtcttcatgaacgagacgtcggaagagc

SEQ ID NO: 47933 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagagaagcagggcaaagaccagcatttccccgtcttcatgaacgagacgtcggaagagc

SEQ ID NO: 47934 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggagcagggcaaagaccagcatttccccgtcttcatgaacgagacgtcggaagagc

SEQ ID NO: 47935 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggagggcaaagaccagcatttccccgtcttcatgaacgagacgtcggaagagc

SEQ ID NO: 47936 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgagaaagaccagcatttccccgtcttcatgaacgagacgtcggaagagc

SEQ ID NO: 47937 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaggaccagcatttccccgtcttcatgaacgagacgtcggaagagc

SEQ ID NO: 47938 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgagcagcatttccccgtcttcatgaacgagacgtcggaagagc

SEQ ID NO: 47939 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggagcatttccccgtcttcatgaacgagacgtcggaagagc

SEQ ID NO: 47940 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgagttccccgtcttcatgaacgagacgtcggaagagc

SEQ ID NO: 47941 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgagcccgtcttcatgaacgagacgtcggaagagc

SEQ ID NO: 47942 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgaggtcttcatgaacgagacgtcggaagagc

SEQ ID NO: 47943 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgagttcatgaacgagacgtcggaagagc

SEQ ID NO: 47944 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgagatgaacgagacgtcggaagagc

SEQ ID NO: 47945 - RNA, 299 nt, synthetic construct
  source 1..299: mol_type = other RNA
cgctcttccgcgtctcaagagggacgacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47946 - RNA, 299 nt, synthetic construct
  source 1..299: mol_type = other RNA
cgctcttccgcgtctcaagagggacatcgactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47947 - RNA, 299 nt, synthetic construct
  source 1..299: mol_type = other RNA
cgctcttccgcgtctcaagagggacatctcggaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47948 - RNA, 299 nt, synthetic construct
  source 1..299: mol_type = other RNA
cgctcttccgcgtctcaagagggacatctcgcgagactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47949 - RNA, 299 nt, synthetic construct
  source 1..299: mol_type = other RNA
cgctcttccgcgtctcaagagggacatctcgcgatttgaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47950 - RNA, 299 nt, synthetic construct
  source 1..299: mol_type = other RNA
cgctcttccgcgtctcaagagggacatctcgcgatttcttgacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47951 - RNA, 299 nt, synthetic construct
  source 1..299: mol_type = other RNA
cgctcttccgcgtctcaagagggacatctcgcgatttcttgaggactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47952 - RNA, 299 nt, synthetic construct
  source 1..299: mol_type = other RNA
cgctcttccgcgtctcaagagggacatctcgcgatttcttgagtctgacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47953 - RNA, 299 nt, synthetic construct
  source 1..299: mol_type = other RNA
cgctcttccgcgtctcaagagggacatctcgcgatttcttgagtctaacgaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47954 - RNA, 299 nt, synthetic construct
  source 1..299: mol_type = other RNA
cgctcttccgcgtctcaagagggacatctcgcgatttcttgagtctaaccccgacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47955 - RNA, 299 nt, synthetic construct
  source 1..299: mol_type = other RNA
cgctcttccgcgtctcaagagggacatctcgcgatttcttgagtctaaccccgtggacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47956 - RNA, 299 nt, synthetic construct
  source 1..299: mol_type = other RNA
cgctcttccgcgtctcaagagggacatctcgcgatttcttgagtctaaccccgtgatggacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47957 - RNA, 299 nt, synthetic construct
  source 1..299: mol_type = other RNA
cgctcttccgcgtctcaagagggacatctcgcgatttcttgagtctaaccccgtgatgattgacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47958 - RNA, 299 nt, synthetic construct; identical to SEQ ID NO: 47957
  source 1..299: mol_type = other RNA

SEQ ID NO: 47959 - RNA, 299 nt, synthetic construct
  source 1..299: mol_type = other RNA
cgctcttccgcgtctcaagagggacatctcgcgatttcttgagtctaaccccgtgatgattgacgccgacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47960 - RNA, 299 nt, synthetic construct
  source 1..299: mol_type = other RNA
cgctcttccgcgtctcaagagggacatctcgcgatttcttgagtctaaccccgtgatgattgacgccaaagacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47961 - RNA, 299 nt, synthetic construct
  source 1..299: mol_type = other RNA
cgctcttccgcgtctcaagagggacatctcgcgatttcttgagtctaaccccgtgatgattgacgccaaagaagacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47962 - RNA, 299 nt, synthetic construct
  source 1..299: mol_type = other RNA
cgctcttccgcgtctcaagagggacatctcgcgatttcttgagtctaaccccgtgatgattgacgccaaagaagtggactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47963 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47964 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47965 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47966 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47967 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47968 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47969 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47970 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47971 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47972 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47973 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47974 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47975 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47976 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47977 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47978 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47979 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47980 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47981 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47982 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47983 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47984 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47985 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47986 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47987 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47988 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47989 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47990 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47991 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47992 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47993 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47994 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47995 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47996 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggacgagcacggcagaatagccaagttcagcaaagtgaggaccattaccaccaggtcaaactctataaagcagggcaaagaccagcatttccccgtcttcatgaacgagacgtcggaagagc

SEQ ID NO: 47997 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggaccacggcagaatagccaagttcagcaaagtgaggaccattaccaccaggtcaaactctataaagcagggcaaagaccagcatttccccgtcttcatgaacgagacgtcggaagagc

SEQ ID NO: 47998 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgacggcagaatagccaagttcagcaaagtgaggaccattaccaccaggtcaaactctataaagcagggcaaagaccagcatttccccgtcttcatgaacgagacgtcggaagagc

SEQ ID NO: 47999 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgacagaatagccaagttcagcaaagtgaggaccattaccaccaggtcaaactctataaagcagggcaaagaccagcatttccccgtcttcatgaacgagacgtcggaagagc

SEQ ID NO: 48000 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagacatagccaagttcagcaaagtgaggaccattaccaccaggtcaaactctataaagcagggcaaagaccagcatttccccgtcttcatgaacgagacgtcggaagagc

SEQ ID NO: 48001 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagacgccaagttcagcaaagtgaggaccattaccaccaggtcaaactctataaagcagggcaaagaccagcatttccccgtcttcatgaacgagacgtcggaagagc

SEQ ID NO: 48002 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgacaagttcagcaaagtgaggaccattaccaccaggtcaaactctataaagcagggcaaagaccagcatttccccgtcttcatgaacgagacgtcggaagagc

SEQ ID NO: 48003 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggacttcagcaaagtgaggaccattaccaccaggtcaaactctataaagcagggcaaagaccagcatttccccgtcttcatgaacgagacgtcggaagagc

SEQ ID NO: 48004 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgacagcaaagtgaggaccattaccaccaggtcaaactctataaagcagggcaaagaccagcatttccccgtcttcatgaacgagacgtcggaagagc

SEQ ID NO: 48005 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgacaaagtgaggaccattaccaccaggtcaaactctataaagcagggcaaagaccagcatttccccgtcttcatgaacgagacgtcggaagagc

SEQ ID NO: 48006 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagacgtgaggaccattaccaccaggtcaaactctataaagcagggcaaagaccagcatttccccgtcttcatgaacgagacgtcggaagagc

SEQ ID NO: 48007 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggacaggaccattaccaccaggtcaaactctataaagcagggcaaagaccagcatttccccgtcttcatgaacgagacgtcggaagagc

SEQ ID NO: 48008 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggacaccattaccaccaggtcaaactctataaagcagggcaaagaccagcatttccccgtcttcatgaacgagacgtcggaagagc

SEQ ID NO: 48009 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgacattaccaccaggtcaaactctataaagcagggcaaagaccagcatttccccgtcttcatgaacgagacgtcggaagagc

SEQ ID NO: 48010 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgacaccaccaggtcaaactctataaagcagggcaaagaccagcatttccccgtcttcatgaacgagacgtcggaagagc

SEQ ID NO: 48011 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgacaccaggtcaaactctataaagcagggcaaagaccagcatttccccgtcttcatgaacgagacgtcggaagagc

SEQ ID NO: 48012 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgacaggtcaaactctataaagcagggcaaagaccagcatttccccgtcttcatgaacgagacgtcggaagagc

SEQ ID NO: 48013 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggactcaaactctataaagcagggcaaagaccagcatttccccgtcttcatgaacgagacgtcggaagagc

SEQ ID NO: 48014 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagacaactctataaagcagggcaaagaccagcatttccccgtcttcatgaacgagacgtcggaagagc

SEQ ID NO: 48015 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgactctataaagcagggcaaagaccagcatttccccgtcttcatgaacgagacgtcggaagagc

SEQ ID NO: 48016 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgacataaagcagggcaaagaccagcatttccccgtcttcatgaacgagacgtcggaagagc

SEQ ID NO: 48017 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagacaagcagggcaaagaccagcatttccccgtcttcatgaacgagacgtcggaagagc

SEQ ID NO: 48018 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggaccagggcaaagaccagcatttccccgtcttcatgaacgagacgtcggaagagc

SEQ ID NO: 48019 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggacggcaaagaccagcatttccccgtcttcatgaacgagacgtcggaagagc

SEQ ID NO: 48020 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgacaaagaccagcatttccccgtcttcatgaacgagacgtcggaagagc

SEQ ID NO: 48021 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgaccagcatttccccgtcttcatgaacgagacgtcggaagagc

SEQ ID NO: 48022 - RNA, 299 nt, synthetic construct; identical to SEQ ID NO: 48021
  source 1..299: mol_type = other RNA

SEQ ID NO: 48023 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggaccatttccccgtcttcatgaacgagacgtcggaagagc

SEQ ID NO: 48024 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgacttccccgtcttcatgaacgagacgtcggaagagc

SEQ ID NO: 48025 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgaccccgtcttcatgaacgagacgtcggaagagc

SEQ ID NO: 48026 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgacgtcttcatgaacgagacgtcggaagagc

SEQ ID NO: 48027 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgacttcatgaacgagacgtcggaagagc

SEQ ID NO: 48028 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgacatgaacgagacgtcggaagagc

SEQ ID NO: 48029 - RNA, 299 nt, synthetic construct
  source 1..299: mol_type = other RNA
cgctcttccgcgtctcaagagggacgtgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48030 - RNA, 299 nt, synthetic construct
  source 1..299: mol_type = other RNA
cgctcttccgcgtctcaagagggacatcgtgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48031 - RNA, 299 nt, synthetic construct
  source 1..299: mol_type = other RNA
cgctcttccgcgtctcaagagggacatctcggtgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48032 - RNA, 299 nt, synthetic construct
  source 1..299: mol_type = other RNA
cgctcttccgcgtctcaagagggacatctcgcgagtgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48033 - RNA, 299 nt, synthetic construct
  source 1..299: mol_type = other RNA
cgctcttccgcgtctcaagagggacatctcgcgatttgtgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48034 - RNA, 299 nt, synthetic construct
  source 1..299: mol_type = other RNA
cgctcttccgcgtctcaagagggacatctcgcgatttcttgtggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48035 - RNA, 299 nt, synthetic construct
  source 1..299: mol_type = other RNA
cgctcttccgcgtctcaagagggacatctcgcgatttcttgaggtgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48036 - RNA, 299 nt, synthetic construct
  source 1..299: mol_type = other RNA
cgctcttccgcgtctcaagagggacatctcgcgatttcttgagtctgtgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48037 - RNA, 299 nt, synthetic construct
  source 1..299: mol_type = other RNA
cgctcttccgcgtctcaagagggacatctcgcgatttcttgagtctaacgtgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48038 - RNA, 299 nt, synthetic construct
  source 1..299: mol_type = other RNA
cgctcttccgcgtctcaagagggacatctcgcgatttcttgagtctaaccccgtggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48039 - RNA, 299 nt, synthetic construct; identical to SEQ ID NO: 48038
  source 1..299: mol_type = other RNA

SEQ ID NO: 48040 - RNA, 299 nt, synthetic construct
  source 1..299: mol_type = other RNA
cgctcttccgcgtctcaagagggacatctcgcgatttcttgagtctaaccccgtgatggtgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48041 - RNA, 299 nt, synthetic construct
  source 1..299: mol_type = other RNA
cgctcttccgcgtctcaagagggacatctcgcgatttcttgagtctaaccccgtgatgattgtggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48042 - RNA, 299 nt, synthetic construct
  source 1..299: mol_type = other RNA
cgctcttccgcgtctcaagagggacatctcgcgatttcttgagtctaaccccgtgatgattgacgtggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48043 - RNA, 299 nt, synthetic construct
  source 1..299: mol_type = other RNA
cgctcttccgcgtctcaagagggacatctcgcgatttcttgagtctaaccccgtgatgattgacgccgtgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48044 - RNA, 299 nt, synthetic construct
  source 1..299: mol_type = other RNA
cgctcttccgcgtctcaagagggacatctcgcgatttcttgagtctaaccccgtgatgattgacgccaaagtggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48045 - RNA, 299 nt, synthetic construct
  source 1..299: mol_type = other RNA
cgctcttccgcgtctcaagagggacatctcgcgatttcttgagtctaaccccgtgatgattgacgccaaagaagtggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48046 - RNA, 299 nt, synthetic construct; identical to SEQ ID NO: 48045
  source 1..299: mol_type = other RNA

SEQ ID NO: 48047 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgtggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48048 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgtggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48049 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagtgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48050 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgtgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48051 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggtggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48052 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgtgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48053 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgtgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48054 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgtgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48055 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgtgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48056 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggtgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48057 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgtgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48058 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgtgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48059 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgtgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48060 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgtgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48061 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgtgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48062 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggtgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48063 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgtgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48064 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggtgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48065 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgtgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48066 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggtggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48067 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagtgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48068 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgtgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48069 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48070 - RNA, 299 nt, synthetic construct; identical to SEQ ID NO: 48069
  source 1..299: mol_type = other RNA

SEQ ID NO: 48071 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgtggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48072 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgtgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48073 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggtgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48074 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggtggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48075 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggtgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48076 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggtgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48077 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagtggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48078 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggtgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48079 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgtgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48080 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggtggagcacggcagaatagccaagttcagcaaagtgaggaccattaccaccaggtcaaactctataaagcagggcaaagaccagcatttccccgtcttcatgaacgagacgtcggaagagc

SEQ ID NO: 48081 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggtgcacggcagaatagccaagttcagcaaagtgaggaccattaccaccaggtcaaactctataaagcagggcaaagaccagcatttccccgtcttcatgaacgagacgtcggaagagc

SEQ ID NO: 48082 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgtgggcagaatagccaagttcagcaaagtgaggaccattaccaccaggtcaaactctataaagcagggcaaagaccagcatttccccgtcttcatgaacgagacgtcggaagagc

SEQ ID NO: 48083 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgtgagaatagccaagttcagcaaagtgaggaccattaccaccaggtcaaactctataaagcagggcaaagaccagcatttccccgtcttcatgaacgagacgtcggaagagc

SEQ ID NO: 48084 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagtgatagccaagttcagcaaagtgaggaccattaccaccaggtcaaactctataaagcagggcaaagaccagcatttccccgtcttcatgaacgagacgtcggaagagc

SEQ ID NO: 48085 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagtggccaagttcagcaaagtgaggaccattaccaccaggtcaaactctataaagcagggcaaagaccagcatttccccgtcttcatgaacgagacgtcggaagagc

SEQ ID NO: 48086 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgtgaagttcagcaaagtgaggaccattaccaccaggtcaaactctataaagcagggcaaagaccagcatttccccgtcttcatgaacgagacgtcggaagagc

SEQ ID NO: 48087 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggtgttcagcaaagtgaggaccattaccaccaggtcaaactctataaagcagggcaaagaccagcatttccccgtcttcatgaacgagacgtcggaagagc

SEQ ID NO: 48088 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgtgagcaaagtgaggaccattaccaccaggtcaaactctataaagcagggcaaagaccagcatttccccgtcttcatgaacgagacgtcggaagagc

SEQ ID NO: 48089 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgtgaaagtgaggaccattaccaccaggtcaaactctataaagcagggcaaagaccagcatttccccgtcttcatgaacgagacgtcggaagagc

SEQ ID NO: 48090 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggtgaggaccattaccaccaggtcaaactctataaagcagggcaaagaccagcatttccccgtcttcatgaacgagacgtcggaagagc

SEQ ID NO: 48091 - RNA, 299 nt, synthetic construct; identical to SEQ ID NO: 48090
  source 1..299: mol_type = other RNA

SEQ ID NO: 48092 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggtgaccattaccaccaggtcaaactctataaagcagggcaaagaccagcatttccccgtcttcatgaacgagacgtcggaagagc

SEQ ID NO: 48093 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgtgattaccaccaggtcaaactctataaagcagggcaaagaccagcatttccccgtcttcatgaacgagacgtcggaagagc

SEQ ID NO: 48094 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgtgaccaccaggtcaaactctataaagcagggcaaagaccagcatttccccgtcttcatgaacgagacgtcggaagagc

SEQ ID NO: 48095 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgtgaccaggtcaaactctataaagcagggcaaagaccagcatttccccgtcttcatgaacgagacgtcggaagagc

SEQ ID NO: 48096 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgtgaggtcaaactctataaagcagggcaaagaccagcatttccccgtcttcatgaacgagacgtcggaagagc

SEQ ID NO: 48097 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggtgtcaaactctataaagcagggcaaagaccagcatttccccgtcttcatgaacgagacgtcggaagagc

SEQ ID NO: 48098 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagtgaactctataaagcagggcaaagaccagcatttccccgtcttcatgaacgagacgtcggaagagc

SEQ ID NO: 48099 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgtgtctataaagcagggcaaagaccagcatttccccgtcttcatgaacgagacgtcggaagagc

SEQ ID NO: 48100 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgtgataaagcagggcaaagaccagcatttccccgtcttcatgaacgagacgtcggaagagc

SEQ ID NO: 48101 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagtgaagcagggcaaagaccagcatttccccgtcttcatgaacgagacgtcggaagagc

SEQ ID NO: 48102 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggtgcagggcaaagaccagcatttccccgtcttcatgaacgagacgtcggaagagc

SEQ ID NO: 48103 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggtgggcaaagaccagcatttccccgtcttcatgaacgagacgtcggaagagc

SEQ ID NO: 48104 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgtgaaagaccagcatttccccgtcttcatgaacgagacgtcggaagagc

SEQ ID NO: 48105 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagtggaccagcatttccccgtcttcatgaacgagacgtcggaagagc

SEQ ID NO: 48106 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgtgcagcatttccccgtcttcatgaacgagacgtcggaagagc

SEQ ID NO: 48107 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggtgcatttccccgtcttcatgaacgagacgtcggaagagc

SEQ ID NO: 48108 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgtgttccccgtcttcatgaacgagacgtcggaagagc

SEQ ID NO: 48109 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgtgcccgtcttcatgaacgagacgtcggaagagc

SEQ ID NO: 48110 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtggtcttcatgaacgagacgtcggaagagc

SEQ ID NO: 48111 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgtgttcatgaacgagacgtcggaagagc

SEQ ID NO: 48112 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgtgatgaacgagacgtcggaagagc

SEQ ID NO: 48113 - RNA, 299 nt, synthetic construct
  source 1..299: mol_type = other RNA
cgctcttccgcgtctcaagagggacgtcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48114 - RNA, 299 nt, synthetic construct
  source 1..299: mol_type = other RNA
cgctcttccgcgtctcaagagggacatcgtctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48115 - RNA, 299 nt, synthetic construct
  source 1..299: mol_type = other RNA
cgctcttccgcgtctcaagagggacatctcggtccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48116 - RNA, 299 nt, synthetic construct
  source 1..299: mol_type = other RNA
cgctcttccgcgtctcaagagggacatctcgcgagtctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48117 - RNA, 299 nt, synthetic construct
  source 1..299: mol_type = other RNA
cgctcttccgcgtctcaagagggacatctcgcgatttgtccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48118 - RNA, 299 nt, synthetic construct
  source 1..299: mol_type = other RNA
cgctcttccgcgtctcaagagggacatctcgcgatttcttgtcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48119 - RNA, 299 nt, synthetic construct
  source 1..299: mol_type = other RNA
cgctcttccgcgtctcaagagggacatctcgcgatttcttgaggtctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48120 - RNA, 299 nt, synthetic construct
  source 1..299: mol_type = other RNA
cgctcttccgcgtctcaagagggacatctcgcgatttcttgagtctgtcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48121 - RNA, 299 nt, synthetic construct
  source 1..299: mol_type = other RNA
cgctcttccgcgtctcaagagggacatctcgcgatttcttgagtctaacgtccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48122 - RNA, 299 nt, synthetic construct
  source 1..299: mol_type = other RNA
cgctcttccgcgtctcaagagggacatctcgcgatttcttgagtctaaccccgtcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48123 - RNA, 299 nt, synthetic construct
  source 1..299: mol_type = other RNA
cgctcttccgcgtctcaagagggacatctcgcgatttcttgagtctaaccccgtggtcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48124 - RNA, 299 nt, synthetic construct
  source 1..299: mol_type = other RNA
cgctcttccgcgtctcaagagggacatctcgcgatttcttgagtctaaccccgtgatggtcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48125 - RNA, 299 nt, synthetic construct
  source 1..299: mol_type = other RNA
cgctcttccgcgtctcaagagggacatctcgcgatttcttgagtctaaccccgtgatgattgtcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48126 - RNA, 299 nt, synthetic construct
  source 1..299: mol_type = other RNA
cgctcttccgcgtctcaagagggacatctcgcgatttcttgagtctaaccccgtgatgattgacgtcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48127 - RNA, 299 nt, synthetic construct
  source 1..299: mol_type = other RNA
cgctcttccgcgtctcaagagggacatctcgcgatttcttgagtctaaccccgtgatgattgacgccgtcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48128 - RNA, 299 nt, synthetic construct
  source 1..299: mol_type = other RNA
cgctcttccgcgtctcaagagggacatctcgcgatttcttgagtctaaccccgtgatgattgacgccaaagtcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48129 - RNA, 299 nt, synthetic construct
  source 1..299: mol_type = other RNA
cgctcttccgcgtctcaagagggacatctcgcgatttcttgagtctaaccccgtgatgattgacgccaaagaagtcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48130 - RNA, 299 nt, synthetic construct
  source 1..299: mol_type = other RNA
cgctcttccgcgtctcaagagggacatctcgcgatttcttgagtctaaccccgtgatgattgacgccaaagaagtggtctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48131 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgtcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48132 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgtcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48133 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagtccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48134 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgtcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48135 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggtcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48136 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgtccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48137 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgtctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48138 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgtcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48139 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgtctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48140 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggtcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48141 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgtcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48142 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgtccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48143 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgtccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48144 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgtcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48145 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgtcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48146 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggtcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48147 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgtcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48148 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggtccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48149 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgtcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48150 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggtcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48151 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagtctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48152 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgtcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48153 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48154 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggtcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48155 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgtcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48156 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgtcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48157 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggtcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48158 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggtcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48159 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggtcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48160 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggtccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48161 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagtcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48162 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggtctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48163 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgtcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48164 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggtcgagcacggcagaatagccaagttcagcaaagtgaggaccattaccaccaggtcaaactctataaagcagggcaaagaccagcatttccccgtcttcatgaacgagacgtcggaagagc

SEQ ID NO: 48165 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggtccacggcagaatagccaagttcagcaaagtgaggaccattaccaccaggtcaaactctataaagcagggcaaagaccagcatttccccgtcttcatgaacgagacgtcggaagagc

SEQ ID NO: 48166 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgtcggcagaatagccaagttcagcaaagtgaggaccattaccaccaggtcaaactctataaagcagggcaaagaccagcatttccccgtcttcatgaacgagacgtcggaagagc

SEQ ID NO: 48167 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgtcagaatagccaagttcagcaaagtgaggaccattaccaccaggtcaaactctataaagcagggcaaagaccagcatttccccgtcttcatgaacgagacgtcggaagagc

SEQ ID NO: 48168 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagtcatagccaagttcagcaaagtgaggaccattaccaccaggtcaaactctataaagcagggcaaagaccagcatttccccgtcttcatgaacgagacgtcggaagagc

SEQ ID NO: 48169 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagtcgccaagttcagcaaagtgaggaccattaccaccaggtcaaactctataaagcagggcaaagaccagcatttccccgtcttcatgaacgagacgtcggaagagc

SEQ ID NO: 48170 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgtcaagttcagcaaagtgaggaccattaccaccaggtcaaactctataaagcagggcaaagaccagcatttccccgtcttcatgaacgagacgtcggaagagc

SEQ ID NO: 48171 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggtcttcagcaaagtgaggaccattaccaccaggtcaaactctataaagcagggcaaagaccagcatttccccgtcttcatgaacgagacgtcggaagagc

SEQ ID NO: 48172 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgtcagcaaagtgaggaccattaccaccaggtcaaactctataaagcagggcaaagaccagcatttccccgtcttcatgaacgagacgtcggaagagc

SEQ ID NO: 48173 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgtcaaagtgaggaccattaccaccaggtcaaactctataaagcagggcaaagaccagcatttccccgtcttcatgaacgagacgtcggaagagc

SEQ ID NO: 48174 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtcgtgaggaccattaccaccaggtcaaactctataaagcagggcaaagaccagcatttccccgtcttcatgaacgagacgtcggaagagc

SEQ ID NO: 48175 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggtcaggaccattaccaccaggtcaaactctataaagcagggcaaagaccagcatttccccgtcttcatgaacgagacgtcggaagagc

SEQ ID NO: 48176 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggtcaccattaccaccaggtcaaactctataaagcagggcaaagaccagcatttccccgtcttcatgaacgagacgtcggaagagc

SEQ ID NO: 48177 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgtcattaccaccaggtcaaactctataaagcagggcaaagaccagcatttccccgtcttcatgaacgagacgtcggaagagc

SEQ ID NO: 48178 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgtcaccaccaggtcaaactctataaagcagggcaaagaccagcatttccccgtcttcatgaacgagacgtcggaagagc

SEQ ID NO: 48179 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgtcaccaggtcaaactctataaagcagggcaaagaccagcatttccccgtcttcatgaacgagacgtcggaagagc

SEQ ID NO: 48180 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgtcaggtcaaactctataaagcagggcaaagaccagcatttccccgtcttcatgaacgagacgtcggaagagc

SEQ ID NO: 48181 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggtctcaaactctataaagcagggcaaagaccagcatttccccgtcttcatgaacgagacgtcggaagagc

SEQ ID NO: 48182 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagtcaactctataaagcagggcaaagaccagcatttccccgtcttcatgaacgagacgtcggaagagc

SEQ ID NO: 48183 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgtctctataaagcagggcaaagaccagcatttccccgtcttcatgaacgagacgtcggaagagc

SEQ ID NO: 48184 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgtcataaagcagggcaaagaccagcatttccccgtcttcatgaacgagacgtcggaagagc

SEQ ID NO: 48185 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagtcaagcagggcaaagaccagcatttccccgtcttcatgaacgagacgtcggaagagc

SEQ ID NO: 48186 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggtccagggcaaagaccagcatttccccgtcttcatgaacgagacgtcggaagagc

SEQ ID NO: 48187 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggtcggcaaagaccagcatttccccgtcttcatgaacgagacgtcggaagagc

SEQ ID NO: 48188 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgtcaaagaccagcatttccccgtcttcatgaacgagacgtcggaagagc

SEQ ID NO: 48189 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagtcgaccagcatttccccgtcttcatgaacgagacgtcggaagagc

SEQ ID NO: 48190 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgtccagcatttccccgtcttcatgaacgagacgtcggaagagc

SEQ ID NO: 48191 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggtccatttccccgtcttcatgaacgagacgtcggaagagc

SEQ ID NO: 48192 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgtcttccccgtcttcatgaacgagacgtcggaagagc

SEQ ID NO: 48193 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgtccccgtcttcatgaacgagacgtcggaagagc

SEQ ID NO: 48194 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgtcttcatgaacgagacgtcggaagagc

SEQ ID NO: 48195 - RNA, 299 nt, synthetic construct; identical to SEQ ID NO: 48194
  source 1..299: mol_type = other RNA

SEQ ID NO: 48196 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgtcatgaacgagacgtcggaagagc

SEQ ID NO: 48197 - RNA, 299 nt, synthetic construct
  source 1..299: mol_type = other RNA
cgctcttccgcgtctcaagagggacgggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48198 - RNA, 299 nt, synthetic construct
  source 1..299: mol_type = other RNA
cgctcttccgcgtctcaagagggacatcgggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48199 - RNA, 299 nt, synthetic construct
  source 1..299: mol_type = other RNA
cgctcttccgcgtctcaagagggacatctcggggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48200 - RNA, 299 nt, synthetic construct
  source 1..299: mol_type = other RNA
cgctcttccgcgtctcaagagggacatctcgcgagggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48201 - RNA, 299 nt, synthetic construct
  source 1..299: mol_type = other RNA
cgctcttccgcgtctcaagagggacatctcgcgatttgggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48202 - RNA, 299 nt, synthetic construct
  source 1..299: mol_type = other RNA
cgctcttccgcgtctcaagagggacatctcgcgatttcttggggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48203 - RNA, 299 nt, synthetic construct
  source 1..299: mol_type = other RNA
cgctcttccgcgtctcaagagggacatctcgcgatttcttgaggggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48204 - RNA, 299 nt, synthetic construct
  source 1..299: mol_type = other RNA
cgctcttccgcgtctcaagagggacatctcgcgatttcttgagtctgggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48205 - RNA, 299 nt, synthetic construct
  source 1..299: mol_type = other RNA
cgctcttccgcgtctcaagagggacatctcgcgatttcttgagtctaacgggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48206 - RNA, 299 nt, synthetic construct
  source 1..299: mol_type = other RNA
cgctcttccgcgtctcaagagggacatctcgcgatttcttgagtctaaccccggggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48207 - RNA, 299 nt, synthetic construct
  source 1..299: mol_type = other RNA
cgctcttccgcgtctcaagagggacatctcgcgatttcttgagtctaaccccgtggggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48208 - RNA, 299 nt, synthetic construct
  source 1..299: mol_type = other RNA
cgctcttccgcgtctcaagagggacatctcgcgatttcttgagtctaaccccgtgatggggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48209 - RNA, 299 nt, synthetic construct
  source 1..299: mol_type = other RNA
cgctcttccgcgtctcaagagggacatctcgcgatttcttgagtctaaccccgtgatgattggggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48210 - RNA, 299 nt, synthetic construct
  source 1..299: mol_type = other RNA
cgctcttccgcgtctcaagagggacatctcgcgatttcttgagtctaaccccgtgatgattgacggggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48211 - RNA, 299 nt, synthetic construct
  source 1..299: mol_type = other RNA
cgctcttccgcgtctcaagagggacatctcgcgatttcttgagtctaaccccgtgatgattgacgccgggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48212 - RNA, 299 nt, synthetic construct
  source 1..299: mol_type = other RNA
cgctcttccgcgtctcaagagggacatctcgcgatttcttgagtctaaccccgtgatgattgacgccaaaggggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48213 - RNA, 299 nt, synthetic construct
  source 1..299: mol_type = other RNA
cgctcttccgcgtctcaagagggacatctcgcgatttcttgagtctaaccccgtgatgattgacgccaaagaaggggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48214 - RNA, 299 nt, synthetic construct
  source 1..299: mol_type = other RNA
cgctcttccgcgtctcaagagggacatctcgcgatttcttgagtctaaccccgtgatgattgacgccaaagaagtggggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48215 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctggggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48216 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctggggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48217 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48218 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48219 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggggggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48220 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48221 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48222 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48223 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48224 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48225 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48226 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48227 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48228 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48229 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48230 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48231 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48232 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48233 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48234 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgggggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48235 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48236 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48237 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactggggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48238 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48239 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatggggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48240 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48241 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48242 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgggggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48243 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48244 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48245 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaggggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48246 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48247 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48248 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgggggagcacggcagaatagccaagttcagcaaagtgaggaccattaccaccaggtcaaactctataaagcagggcaaagaccagcatttccccgtcttcatgaacgagacgtcggaagagc

SEQ ID NO: 48249 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggggcacggcagaatagccaagttcagcaaagtgaggaccattaccaccaggtcaaactctataaagcagggcaaagaccagcatttccccgtcttcatgaacgagacgtcggaagagc

SEQ ID NO: 48250 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgggggcagaatagccaagttcagcaaagtgaggaccattaccaccaggtcaaactctataaagcagggcaaagaccagcatttccccgtcttcatgaacgagacgtcggaagagc

SEQ ID NO: 48251 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgggagaatagccaagttcagcaaagtgaggaccattaccaccaggtcaaactctataaagcagggcaaagaccagcatttccccgtcttcatgaacgagacgtcggaagagc

SEQ ID NO: 48252 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagggatagccaagttcagcaaagtgaggaccattaccaccaggtcaaactctataaagcagggcaaagaccagcatttccccgtcttcatgaacgagacgtcggaagagc

SEQ ID NO: 48253 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataggggccaagttcagcaaagtgaggaccattaccaccaggtcaaactctataaagcagggcaaagaccagcatttccccgtcttcatgaacgagacgtcggaagagc

SEQ ID NO: 48254 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgggaagttcagcaaagtgaggaccattaccaccaggtcaaactctataaagcagggcaaagaccagcatttccccgtcttcatgaacgagacgtcggaagagc

SEQ ID NO: 48255 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggggttcagcaaagtgaggaccattaccaccaggtcaaactctataaagcagggcaaagaccagcatttccccgtcttcatgaacgagacgtcggaagagc

SEQ ID NO: 48256 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgggagcaaagtgaggaccattaccaccaggtcaaactctataaagcagggcaaagaccagcatttccccgtcttcatgaacgagacgtcggaagagc

SEQ ID NO: 48257 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgggaaagtgaggaccattaccaccaggtcaaactctataaagcagggcaaagaccagcatttccccgtcttcatgaacgagacgtcggaagagc

SEQ ID NO: 48258 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaggggtgaggaccattaccaccaggtcaaactctataaagcagggcaaagaccagcatttccccgtcttcatgaacgagacgtcggaagagc

SEQ ID NO: 48259 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggggaggaccattaccaccaggtcaaactctataaagcagggcaaagaccagcatttccccgtcttcatgaacgagacgtcggaagagc

SEQ ID NO: 48260 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggggaccattaccaccaggtcaaactctataaagcagggcaaagaccagcatttccccgtcttcatgaacgagacgtcggaagagc

SEQ ID NO: 48261 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgggattaccaccaggtcaaactctataaagcagggcaaagaccagcatttccccgtcttcatgaacgagacgtcggaagagc

SEQ ID NO: 48262 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgggaccaccaggtcaaactctataaagcagggcaaagaccagcatttccccgtcttcatgaacgagacgtcggaagagc

SEQ ID NO: 48263 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgggaccaggtcaaactctataaagcagggcaaagaccagcatttccccgtcttcatgaacgagacgtcggaagagc

SEQ ID NO: 48264 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgggaggtcaaactctataaagcagggcaaagaccagcatttccccgtcttcatgaacgagacgtcggaagagc

SEQ ID NO: 48265 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggggtcaaactctataaagcagggcaaagaccagcatttccccgtcttcatgaacgagacgtcggaagagc

SEQ ID NO: 48266 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagggaactctataaagcagggcaaagaccagcatttccccgtcttcatgaacgagacgtcggaagagc

SEQ ID NO: 48267 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgggtctataaagcagggcaaagaccagcatttccccgtcttcatgaacgagacgtcggaagagc

SEQ ID NO: 48268 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgggataaagcagggcaaagaccagcatttccccgtcttcatgaacgagacgtcggaagagc

SEQ ID NO: 48269 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagggaagcagggcaaagaccagcatttccccgtcttcatgaacgagacgtcggaagagc

SEQ ID NO: 48270 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggggcagggcaaagaccagcatttccccgtcttcatgaacgagacgtcggaagagc

SEQ ID NO: 48271 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggggggcaaagaccagcatttccccgtcttcatgaacgagacgtcggaagagc

SEQ ID NO: 48272 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgggaaagaccagcatttccccgtcttcatgaacgagacgtcggaagagc

SEQ ID NO: 48273 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaggggaccagcatttccccgtcttcatgaacgagacgtcggaagagc

SEQ ID NO: 48274 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgggcagcatttccccgtcttcatgaacgagacgtcggaagagc

SEQ ID NO: 48275 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggggcatttccccgtcttcatgaacgagacgtcggaagagc

SEQ ID NO: 48276 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgggttccccgtcttcatgaacgagacgtcggaagagc

SEQ ID NO: 48277 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgggcccgtcttcatgaacgagacgtcggaagagc

SEQ ID NO: 48278 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccggggtcttcatgaacgagacgtcggaagagc

SEQ ID NO: 48279 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgggttcatgaacgagacgtcggaagagc

SEQ ID NO: 48280 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgggatgaacgagacgtcggaagagc

SEQ ID NO: 48281 - RNA, 299 nt, synthetic construct
  source 1..299: mol_type = other RNA
cgctcttccgcgtctcaagagggacggcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48282 - RNA, 299 nt, synthetic construct
  source 1..299: mol_type = other RNA
cgctcttccgcgtctcaagagggacatcggctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48283 - RNA, 299 nt, synthetic construct
  source 1..299: mol_type = other RNA
cgctcttccgcgtctcaagagggacatctcgggccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48284 - RNA, 299 nt, synthetic construct
  source 1..299: mol_type = other RNA
cgctcttccgcgtctcaagagggacatctcgcgaggctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48285 - RNA, 299 nt, synthetic construct
  source 1..299: mol_type = other RNA
cgctcttccgcgtctcaagagggacatctcgcgatttggccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48286 - RNA, 299 nt, synthetic construct
  source 1..299: mol_type = other RNA
cgctcttccgcgtctcaagagggacatctcgcgatttcttggcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48287 - RNA, 299 nt, synthetic construct
  source 1..299: mol_type = other RNA
cgctcttccgcgtctcaagagggacatctcgcgatttcttgagggctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48288 - RNA, 299 nt, synthetic construct
  source 1..299: mol_type = other RNA
cgctcttccgcgtctcaagagggacatctcgcgatttcttgagtctggcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48289 - RNA, 299 nt, synthetic construct
  source 1..299: mol_type = other RNA
cgctcttccgcgtctcaagagggacatctcgcgatttcttgagtctaacggccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48290 - RNA, 299 nt, synthetic construct
  source 1..299: mol_type = other RNA
cgctcttccgcgtctcaagagggacatctcgcgatttcttgagtctaaccccggcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48291 - RNA, 299 nt, synthetic construct
  source 1..299: mol_type = other RNA
cgctcttccgcgtctcaagagggacatctcgcgatttcttgagtctaaccccgtgggcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48292 - RNA, 299 nt, synthetic construct
  source 1..299: mol_type = other RNA
cgctcttccgcgtctcaagagggacatctcgcgatttcttgagtctaaccccgtgatgggcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48293 - RNA, 299 nt, synthetic construct
  source 1..299: mol_type = other RNA
cgctcttccgcgtctcaagagggacatctcgcgatttcttgagtctaaccccgtgatgattggcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48294 - RNA, 299 nt, synthetic construct
  source 1..299: mol_type = other RNA
cgctcttccgcgtctcaagagggacatctcgcgatttcttgagtctaaccccgtgatgattgacggcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48295 - RNA, 299 nt, synthetic construct
  source 1..299: mol_type = other RNA
cgctcttccgcgtctcaagagggacatctcgcgatttcttgagtctaaccccgtgatgattgacgccggcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48296 - RNA, 299 nt, synthetic construct
  source 1..299: mol_type = other RNA
cgctcttccgcgtctcaagagggacatctcgcgatttcttgagtctaaccccgtgatgattgacgccaaaggcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48297 - RNA, 299 nt, synthetic construct
  source 1..299: mol_type = other RNA
cgctcttccgcgtctcaagagggacatctcgcgatttcttgagtctaaccccgtgatgattgacgccaaagaaggcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48298 - RNA, 299 nt, synthetic construct
  source 1..299: mol_type = other RNA
cgctcttccgcgtctcaagagggacatctcgcgatttcttgagtctaaccccgtgatgattgacgccaaagaagtgggctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48299 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctggcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48300 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctggcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48301 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaggccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48302 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacggcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48303 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggggcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48304 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccggccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48305 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtggctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48306 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacggcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48307 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcggctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48308 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48309 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtggcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48310 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacggccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48311 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttggccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48312 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48313 - RNA, 299 nt, synthetic construct; identical to SEQ ID NO: 48312
  source 1..299: mol_type = other RNA

SEQ ID NO: 48314 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgggcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48315 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacggcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48316 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggggccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48317 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctggcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48318 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgggcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48319 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaggctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48320 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccggcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48321 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactggcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48322 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgggcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48323 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatggcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48324 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatggcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48325 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagggcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48326 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgggcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48327 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagggcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48328 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgggccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48329 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaggcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48330 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagggctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48331 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtggcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48332 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgggcgagcacggcagaatagccaagttcagcaaagtgaggaccattaccaccaggtcaaactctataaagcagggcaaagaccagcatttccccgtcttcatgaacgagacgtcggaagagc

SEQ ID NO: 48333 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagggccacggcagaatagccaagttcagcaaagtgaggaccattaccaccaggtcaaactctataaagcagggcaaagaccagcatttccccgtcttcatgaacgagacgtcggaagagc

SEQ ID NO: 48334 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcggcagaatagccaagttcagcaaagtgaggaccattaccaccaggtcaaactctataaagcagggcaaagaccagcatttccccgtcttcatgaacgagacgtcggaagagc

SEQ ID NO: 48335 - RNA, 299 nt, synthetic construct; identical to SEQ ID NO: 48334
  source 1..299: mol_type = other RNA

SEQ ID NO: 48336 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaggcatagccaagttcagcaaagtgaggaccattaccaccaggtcaaactctataaagcagggcaaagaccagcatttccccgtcttcatgaacgagacgtcggaagagc

SEQ ID NO: 48337 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataggcgccaagttcagcaaagtgaggaccattaccaccaggtcaaactctataaagcagggcaaagaccagcatttccccgtcttcatgaacgagacgtcggaagagc

SEQ ID NO: 48338 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccggcaagttcagcaaagtgaggaccattaccaccaggtcaaactctataaagcagggcaaagaccagcatttccccgtcttcatgaacgagacgtcggaagagc

SEQ ID NO: 48339 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagggcttcagcaaagtgaggaccattaccaccaggtcaaactctataaagcagggcaaagaccagcatttccccgtcttcatgaacgagacgtcggaagagc

SEQ ID NO: 48340 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcggcagcaaagtgaggaccattaccaccaggtcaaactctataaagcagggcaaagaccagcatttccccgtcttcatgaacgagacgtcggaagagc

SEQ ID NO: 48341 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcggcaaagtgaggaccattaccaccaggtcaaactctataaagcagggcaaagaccagcatttccccgtcttcatgaacgagacgtcggaagagc

SEQ ID NO: 48342 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaggcgtgaggaccattaccaccaggtcaaactctataaagcagggcaaagaccagcatttccccgtcttcatgaacgagacgtcggaagagc

SEQ ID NO: 48343 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgggcaggaccattaccaccaggtcaaactctataaagcagggcaaagaccagcatttccccgtcttcatgaacgagacgtcggaagagc

SEQ ID NO: 48344 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggggcaccattaccaccaggtcaaactctataaagcagggcaaagaccagcatttccccgtcttcatgaacgagacgtcggaagagc

SEQ ID NO: 48345 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccggcattaccaccaggtcaaactctataaagcagggcaaagaccagcatttccccgtcttcatgaacgagacgtcggaagagc

SEQ ID NO: 48346 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattggcaccaccaggtcaaactctataaagcagggcaaagaccagcatttccccgtcttcatgaacgagacgtcggaagagc

SEQ ID NO: 48347 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccggcaccaggtcaaactctataaagcagggcaaagaccagcatttccccgtcttcatgaacgagacgtcggaagagc

SEQ ID NO: 48348 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccggcaggtcaaactctataaagcagggcaaagaccagcatttccccgtcttcatgaacgagacgtcggaagagc

SEQ ID NO: 48349 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggggctcaaactctataaagcagggcaaagaccagcatttccccgtcttcatgaacgagacgtcggaagagc

SEQ ID NO: 48350 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaggcaactctataaagcagggcaaagaccagcatttccccgtcttcatgaacgagacgtcggaagagc

SEQ ID NO: 48351 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacggctctataaagcagggcaaagaccagcatttccccgtcttcatgaacgagacgtcggaagagc

SEQ ID NO: 48352 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctggcataaagcagggcaaagaccagcatttccccgtcttcatgaacgagacgtcggaagagc

SEQ ID NO: 48353 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataggcaagcagggcaaagaccagcatttccccgtcttcatgaacgagacgtcggaagagc

SEQ ID NO: 48354 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagggccagggcaaagaccagcatttccccgtcttcatgaacgagacgtcggaagagc

SEQ ID NO: 48355 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcggcaaagaccagcatttccccgtcttcatgaacgagacgtcggaagagc

SEQ ID NO: 48356 - RNA, 299 nt, synthetic construct; identical to SEQ ID NO: 48355
  source 1..299: mol_type = other RNA

SEQ ID NO: 48357 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaggcgaccagcatttccccgtcttcatgaacgagacgtcggaagagc

SEQ ID NO: 48358 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacggccagcatttccccgtcttcatgaacgagacgtcggaagagc

SEQ ID NO: 48359 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagggccatttccccgtcttcatgaacgagacgtcggaagagc

SEQ ID NO: 48360 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatggcttccccgtcttcatgaacgagacgtcggaagagc

SEQ ID NO: 48361 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcggccccgtcttcatgaacgagacgtcggaagagc

SEQ ID NO: 48362 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccggcgtcttcatgaacgagacgtcggaagagc

SEQ ID NO: 48363 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcggcttcatgaacgagacgtcggaagagc

SEQ ID NO: 48364 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcggcatgaacgagacgtcggaagagc

SEQ ID NO: 48365 - RNA, 299 nt, synthetic construct
  source 1..299: mol_type = other RNA
cgctcttccgcgtctcaagagggacgcgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48366 - RNA, 299 nt, synthetic construct
  source 1..299: mol_type = other RNA
cgctcttccgcgtctcaagagggacatcgcgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48367 - RNA, 299 nt, synthetic construct
  source 1..299: mol_type = other RNA
cgctcttccgcgtctcaagagggacatctcggcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48368 - RNA, 299 nt, synthetic construct
  source 1..299: mol_type = other RNA
cgctcttccgcgtctcaagagggacatctcgcgagcgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48369 - RNA, 299 nt, synthetic construct
  source 1..299: mol_type = other RNA
cgctcttccgcgtctcaagagggacatctcgcgatttgcgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48370 - RNA, 299 nt, synthetic construct
  source 1..299: mol_type = other RNA
cgctcttccgcgtctcaagagggacatctcgcgatttcttgcggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48371 - RNA, 299 nt, synthetic construct
  source 1..299: mol_type = other RNA
cgctcttccgcgtctcaagagggacatctcgcgatttcttgaggcgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48372 - RNA, 299 nt, synthetic construct
  source 1..299: mol_type = other RNA
cgctcttccgcgtctcaagagggacatctcgcgatttcttgagtctgcgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48373 - RNA, 299 nt, synthetic construct
  source 1..299: mol_type = other RNA
cgctcttccgcgtctcaagagggacatctcgcgatttcttgagtctaacgcgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48374 - RNA, 299 nt, synthetic construct
  source 1..299: mol_type = other RNA
cgctcttccgcgtctcaagagggacatctcgcgatttcttgagtctaaccccgcggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48375 - RNA, 299 nt, synthetic construct
  source 1..299: mol_type = other RNA
cgctcttccgcgtctcaagagggacatctcgcgatttcttgagtctaaccccgtggcgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48376 - RNA, 299 nt, synthetic construct
  source 1..299: mol_type = other RNA
cgctcttccgcgtctcaagagggacatctcgcgatttcttgagtctaaccccgtgatggcgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48377 - RNA, 299 nt, synthetic construct
  source 1..299: mol_type = other RNA
cgctcttccgcgtctcaagagggacatctcgcgatttcttgagtctaaccccgtgatgattgcggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48378 - RNA, 299 nt, synthetic construct
  source 1..299: mol_type = other RNA
cgctcttccgcgtctcaagagggacatctcgcgatttcttgagtctaaccccgtgatgattgacgcggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48379 - RNA, 299 nt, synthetic construct
  source 1..299: mol_type = other RNA
cgctcttccgcgtctcaagagggacatctcgcgatttcttgagtctaaccccgtgatgattgacgccgcgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48380 - RNA, 299 nt, synthetic construct
  source 1..299: mol_type = other RNA
cgctcttccgcgtctcaagagggacatctcgcgatttcttgagtctaaccccgtgatgattgacgccaaagcggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48381 - RNA, 299 nt, synthetic construct
  source 1..299: mol_type = other RNA
cgctcttccgcgtctcaagagggacatctcgcgatttcttgagtctaaccccgtgatgattgacgccaaagaagcggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48382 - RNA, 299 nt, synthetic construct
  source 1..299: mol_type = other RNA
cgctcttccgcgtctcaagagggacatctcgcgatttcttgagtctaaccccgtgatgattgacgccaaagaagtggcgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48383 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgcggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48384 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48385 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagcgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48386 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgcgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48387 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48388 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgcgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48389 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgcgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48390 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgcgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48391 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgcgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48392 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggcgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48393 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgcgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48394 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgcgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48395 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgcgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48396 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgcgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48397 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgcgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48398 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggcgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48399 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgcgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48400 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggcgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48401 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgcgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48402 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48403 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagcgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48404 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgcgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48405 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgcggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48406 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggcgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48407 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgcggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48408 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgcgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48409 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggcgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48410 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggcggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48411 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggcgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48412 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggcgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48413 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagcggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48414 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggcgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48415 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgcgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48416 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggcggagcacggcagaatagccaagttcagcaaagtgaggaccattaccaccaggtcaaactctataaagcagggcaaagaccagcatttccccgtcttcatgaacgagacgtcggaagagc

SEQ ID NO: 48417 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggcgcacggcagaatagccaagttcagcaaagtgaggaccattaccaccaggtcaaactctataaagcagggcaaagaccagcatttccccgtcttcatgaacgagacgtcggaagagc

SEQ ID NO: 48418 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgcgggcagaatagccaagttcagcaaagtgaggaccattaccaccaggtcaaactctataaagcagggcaaagaccagcatttccccgtcttcatgaacgagacgtcggaagagc

SEQ ID NO: 48419 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgcgagaatagccaagttcagcaaagtgaggaccattaccaccaggtcaaactctataaagcagggcaaagaccagcatttccccgtcttcatgaacgagacgtcggaagagc

SEQ ID NO: 48420 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagcgatagccaagttcagcaaagtgaggaccattaccaccaggtcaaactctataaagcagggcaaagaccagcatttccccgtcttcatgaacgagacgtcggaagagc

SEQ ID NO: 48421 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcggccaagttcagcaaagtgaggaccattaccaccaggtcaaactctataaagcagggcaaagaccagcatttccccgtcttcatgaacgagacgtcggaagagc

SEQ ID NO: 48422 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgcgaagttcagcaaagtgaggaccattaccaccaggtcaaactctataaagcagggcaaagaccagcatttccccgtcttcatgaacgagacgtcggaagagc

SEQ ID NO: 48423 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggcgttcagcaaagtgaggaccattaccaccaggtcaaactctataaagcagggcaaagaccagcatttccccgtcttcatgaacgagacgtcggaagagc

SEQ ID NO: 48424 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgcgagcaaagtgaggaccattaccaccaggtcaaactctataaagcagggcaaagaccagcatttccccgtcttcatgaacgagacgtcggaagagc

SEQ ID NO: 48425 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgcgaaagtgaggaccattaccaccaggtcaaactctataaagcagggcaaagaccagcatttccccgtcttcatgaacgagacgtcggaagagc

SEQ ID NO: 48426 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagcggtgaggaccattaccaccaggtcaaactctataaagcagggcaaagaccagcatttccccgtcttcatgaacgagacgtcggaagagc

SEQ ID NO: 48427 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggcgaggaccattaccaccaggtcaaactctataaagcagggcaaagaccagcatttccccgtcttcatgaacgagacgtcggaagagc

SEQ ID NO: 48428 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggcgaccattaccaccaggtcaaactctataaagcagggcaaagaccagcatttccccgtcttcatgaacgagacgtcggaagagc

SEQ ID NO: 48429 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgcgattaccaccaggtcaaactctataaagcagggcaaagaccagcatttccccgtcttcatgaacgagacgtcggaagagc

SEQ ID NO: 48430 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgcgaccaccaggtcaaactctataaagcagggcaaagaccagcatttccccgtcttcatgaacgagacgtcggaagagc

SEQ ID NO: 48431 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgcgaccaggtcaaactctataaagcagggcaaagaccagcatttccccgtcttcatgaacgagacgtcggaagagc

SEQ ID NO: 48432 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgcgaggtcaaactctataaagcagggcaaagaccagcatttccccgtcttcatgaacgagacgtcggaagagc

SEQ ID NO: 48433 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggcgtcaaactctataaagcagggcaaagaccagcatttccccgtcttcatgaacgagacgtcggaagagc

SEQ ID NO: 48434 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagcgaactctataaagcagggcaaagaccagcatttccccgtcttcatgaacgagacgtcggaagagc

SEQ ID NO: 48435 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgcgtctataaagcagggcaaagaccagcatttccccgtcttcatgaacgagacgtcggaagagc

SEQ ID NO: 48436 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgcgataaagcagggcaaagaccagcatttccccgtcttcatgaacgagacgtcggaagagc

SEQ ID NO: 48437 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagcgaagcagggcaaagaccagcatttccccgtcttcatgaacgagacgtcggaagagc

SEQ ID NO: 48438 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggcgcagggcaaagaccagcatttccccgtcttcatgaacgagacgtcggaagagc

SEQ ID NO: 48439 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggcgggcaaagaccagcatttccccgtcttcatgaacgagacgtcggaagagc

SEQ ID NO: 48440 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgcgaaagaccagcatttccccgtcttcatgaacgagacgtcggaagagc

SEQ ID NO: 48441 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagcggaccagcatttccccgtcttcatgaacgagacgtcggaagagc

SEQ ID NO: 48442 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgcgcagcatttccccgtcttcatgaacgagacgtcggaagagc

SEQ ID NO: 48443 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggcgcatttccccgtcttcatgaacgagacgtcggaagagc

SEQ ID NO: 48444 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgcgttccccgtcttcatgaacgagacgtcggaagagc

SEQ ID NO: 48445 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgcgcccgtcttcatgaacgagacgtcggaagagc

SEQ ID NO: 48446 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgcggtcttcatgaacgagacgtcggaagagc

SEQ ID NO: 48447 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgcgttcatgaacgagacgtcggaagagc

SEQ ID NO: 48448 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgcgatgaacgagacgtcggaagagc

SEQ ID NO: 48449 - RNA, 299 nt, synthetic construct
  source 1..299: mol_type = other RNA
cgctcttccgcgtctcaagagggacgccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48450 - RNA, 299 nt, synthetic construct
  source 1..299: mol_type = other RNA
cgctcttccgcgtctcaagagggacatcgcctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48451 - RNA, 299 nt, synthetic construct
  source 1..299: mol_type = other RNA
cgctcttccgcgtctcaagagggacatctcggcccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48452 - RNA, 299 nt, synthetic construct
  source 1..299: mol_type = other RNA
cgctcttccgcgtctcaagagggacatctcgcgagcctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48453 - RNA, 299 nt, synthetic construct
  source 1..299: mol_type = other RNA
cgctcttccgcgtctcaagagggacatctcgcgatttgcccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48454 - RNA, 299 nt, synthetic construct
  source 1..299: mol_type = other RNA
cgctcttccgcgtctcaagagggacatctcgcgatttcttgccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48455 - RNA, 299 nt, synthetic construct
  source 1..299: mol_type = other RNA
cgctcttccgcgtctcaagagggacatctcgcgatttcttgaggcctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48456 - RNA, 299 nt, synthetic construct
  source 1..299: mol_type = other RNA
cgctcttccgcgtctcaagagggacatctcgcgatttcttgagtctgccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48457 - RNA, 299 nt, synthetic construct
  source 1..299: mol_type = other RNA
cgctcttccgcgtctcaagagggacatctcgcgatttcttgagtctaacgcccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48458 - RNA, 299 nt, synthetic construct
  source 1..299: mol_type = other RNA
cgctcttccgcgtctcaagagggacatctcgcgatttcttgagtctaaccccgccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48459 - RNA, 299 nt, synthetic construct
  source 1..299: mol_type = other RNA
cgctcttccgcgtctcaagagggacatctcgcgatttcttgagtctaaccccgtggccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48460 - RNA, 299 nt, synthetic construct
  source 1..299: mol_type = other RNA
cgctcttccgcgtctcaagagggacatctcgcgatttcttgagtctaaccccgtgatggccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48461 - RNA, 299 nt, synthetic construct
  source 1..299: mol_type = other RNA
cgctcttccgcgtctcaagagggacatctcgcgatttcttgagtctaaccccgtgatgattgccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48462 - RNA, 299 nt, synthetic construct
  source 1..299: mol_type = other RNA
cgctcttccgcgtctcaagagggacatctcgcgatttcttgagtctaaccccgtgatgattgacgccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48463 - RNA, 299 nt, synthetic construct; identical to SEQ ID NO: 48462
  source 1..299: mol_type = other RNA

SEQ ID NO: 48464 - RNA, 299 nt, synthetic construct
  source 1..299: mol_type = other RNA
cgctcttccgcgtctcaagagggacatctcgcgatttcttgagtctaaccccgtgatgattgacgccaaagccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48465 - RNA, 299 nt, synthetic construct
  source 1..299: mol_type = other RNA
cgctcttccgcgtctcaagagggacatctcgcgatttcttgagtctaaccccgtgatgattgacgccaaagaagccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48466 - RNA, 299 nt, synthetic construct
  source 1..299: mol_type = other RNA
cgctcttccgcgtctcaagagggacatctcgcgatttcttgagtctaaccccgtgatgattgacgccaaagaagtggcctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48467 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48468 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48469 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcagcccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48470 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacgccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48471 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48472 - RNA, 299 nt, synthetic construct; identical to SEQ ID NO: 48471
  source 1..299: mol_type = other RNA

SEQ ID NO: 48473 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtgcctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48474 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacgccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48475 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcgcctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48476 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctgggccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48477 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtgccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48478 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacgcccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48479 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttgcccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48480 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48481 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48482 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48483 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48484 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggcccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48485 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48486 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48487 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagcctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48488 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48489 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48490 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48491 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48492 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48493 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48494 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48495 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48496 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggcccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48497 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48498 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggcctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48499 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48500 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggccgagcacggcagaatagccaagttcagcaaagtgaggaccattaccaccaggtcaaactctataaagcagggcaaagaccagcatttccccgtcttcatgaacgagacgtcggaagagc

SEQ ID NO: 48501 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggcccacggcagaatagccaagttcagcaaagtgaggaccattaccaccaggtcaaactctataaagcagggcaaagaccagcatttccccgtcttcatgaacgagacgtcggaagagc

SEQ ID NO: 48502 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgccggcagaatagccaagttcagcaaagtgaggaccattaccaccaggtcaaactctataaagcagggcaaagaccagcatttccccgtcttcatgaacgagacgtcggaagagc

SEQ ID NO: 48503 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgccagaatagccaagttcagcaaagtgaggaccattaccaccaggtcaaactctataaagcagggcaaagaccagcatttccccgtcttcatgaacgagacgtcggaagagc

SEQ ID NO: 48504 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagccatagccaagttcagcaaagtgaggaccattaccaccaggtcaaactctataaagcagggcaaagaccagcatttccccgtcttcatgaacgagacgtcggaagagc

SEQ ID NO: 48505 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgccaagttcagcaaagtgaggaccattaccaccaggtcaaactctataaagcagggcaaagaccagcatttccccgtcttcatgaacgagacgtcggaagagc

SEQ ID NO: 48506 - RNA, 299 nt, synthetic construct; identical to SEQ ID NO: 48505
  source 1..299: mol_type = other RNA

SEQ ID NO: 48507 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggccttcagcaaagtgaggaccattaccaccaggtcaaactctataaagcagggcaaagaccagcatttccccgtcttcatgaacgagacgtcggaagagc

SEQ ID NO: 48508 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgccagcaaagtgaggaccattaccaccaggtcaaactctataaagcagggcaaagaccagcatttccccgtcttcatgaacgagacgtcggaagagc

SEQ ID NO: 48509 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgccaaagtgaggaccattaccaccaggtcaaactctataaagcagggcaaagaccagcatttccccgtcttcatgaacgagacgtcggaagagc

SEQ ID NO: 48510 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagccgtgaggaccattaccaccaggtcaaactctataaagcagggcaaagaccagcatttccccgtcttcatgaacgagacgtcggaagagc

SEQ ID NO: 48511 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggccaggaccattaccaccaggtcaaactctataaagcagggcaaagaccagcatttccccgtcttcatgaacgagacgtcggaagagc

SEQ ID NO: 48512 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggccaccattaccaccaggtcaaactctataaagcagggcaaagaccagcatttccccgtcttcatgaacgagacgtcggaagagc

SEQ ID NO: 48513 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgccattaccaccaggtcaaactctataaagcagggcaaagaccagcatttccccgtcttcatgaacgagacgtcggaagagc

SEQ ID NO: 48514 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgccaccaccaggtcaaactctataaagcagggcaaagaccagcatttccccgtcttcatgaacgagacgtcggaagagc

SEQ ID NO: 48515 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgccaccaggtcaaactctataaagcagggcaaagaccagcatttccccgtcttcatgaacgagacgtcggaagagc

SEQ ID NO: 48516 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgccaggtcaaactctataaagcagggcaaagaccagcatttccccgtcttcatgaacgagacgtcggaagagc

SEQ ID NO: 48517 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggcctcaaactctataaagcagggcaaagaccagcatttccccgtcttcatgaacgagacgtcggaagagc

SEQ ID NO: 48518 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagccaactctataaagcagggcaaagaccagcatttccccgtcttcatgaacgagacgtcggaagagc

SEQ ID NO: 48519 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgcctctataaagcagggcaaagaccagcatttccccgtcttcatgaacgagacgtcggaagagc

SEQ ID NO: 48520 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgccataaagcagggcaaagaccagcatttccccgtcttcatgaacgagacgtcggaagagc

SEQ ID NO: 48521 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagccaagcagggcaaagaccagcatttccccgtcttcatgaacgagacgtcggaagagc

SEQ ID NO: 48522 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggcccagggcaaagaccagcatttccccgtcttcatgaacgagacgtcggaagagc

SEQ ID NO: 48523 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggccggcaaagaccagcatttccccgtcttcatgaacgagacgtcggaagagc

SEQ ID NO: 48524 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgccaaagaccagcatttccccgtcttcatgaacgagacgtcggaagagc

SEQ ID NO: 48525 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagccgaccagcatttccccgtcttcatgaacgagacgtcggaagagc

SEQ ID NO: 48526 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgcccagcatttccccgtcttcatgaacgagacgtcggaagagc

SEQ ID NO: 48527 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggcccatttccccgtcttcatgaacgagacgtcggaagagc

SEQ ID NO: 48528 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgccttccccgtcttcatgaacgagacgtcggaagagc

SEQ ID NO: 48529 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgcccccgtcttcatgaacgagacgtcggaagagc

SEQ ID NO: 48530 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgccgtcttcatgaacgagacgtcggaagagc

SEQ ID NO: 48531 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgccttcatgaacgagacgtcggaagagc

SEQ ID NO: 48532 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcgccatgaacgagacgtcggaagagc

SEQ ID NO: 48533 - RNA, 299 nt, synthetic construct
  source 1..299: mol_type = other RNA
cgctcttccgcgtctcaagagggaccagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48534 - RNA, 299 nt, synthetic construct
  source 1..299: mol_type = other RNA
cgctcttccgcgtctcaagagggacatccagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48535 - RNA, 299 nt, synthetic construct
  source 1..299: mol_type = other RNA
cgctcttccgcgtctcaagagggacatctcgcagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48536 - RNA, 299 nt, synthetic construct
  source 1..299: mol_type = other RNA
cgctcttccgcgtctcaagagggacatctcgcgacagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48537 - RNA, 299 nt, synthetic construct
  source 1..299: mol_type = other RNA
cgctcttccgcgtctcaagagggacatctcgcgatttcagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48538 - RNA, 299 nt, synthetic construct
  source 1..299: mol_type = other RNA
cgctcttccgcgtctcaagagggacatctcgcgatttcttcaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48539 - RNA, 299 nt, synthetic construct
  source 1..299: mol_type = other RNA
cgctcttccgcgtctcaagagggacatctcgcgatttcttgagcagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48540 - RNA, 299 nt, synthetic construct
  source 1..299: mol_type = other RNA
cgctcttccgcgtctcaagagggacatctcgcgatttcttgagtctcagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48541 - RNA, 299 nt, synthetic construct
  source 1..299: mol_type = other RNA
cgctcttccgcgtctcaagagggacatctcgcgatttcttgagtctaaccagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48542 - RNA, 299 nt, synthetic construct
  source 1..299: mol_type = other RNA
cgctcttccgcgtctcaagagggacatctcgcgatttcttgagtctaacccccaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48543 - RNA, 299 nt, synthetic construct
  source 1..299: mol_type = other RNA
cgctcttccgcgtctcaagagggacatctcgcgatttcttgagtctaaccccgtgcagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48544 - RNA, 299 nt, synthetic construct
  source 1..299: mol_type = other RNA
cgctcttccgcgtctcaagagggacatctcgcgatttcttgagtctaaccccgtgatgcagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48545 - RNA, 299 nt, synthetic construct
  source 1..299: mol_type = other RNA
cgctcttccgcgtctcaagagggacatctcgcgatttcttgagtctaaccccgtgatgattcaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48546 - RNA, 299 nt, synthetic construct
  source 1..299: mol_type = other RNA
cgctcttccgcgtctcaagagggacatctcgcgatttcttgagtctaaccccgtgatgattgaccaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48547 - RNA, 299 nt, synthetic construct
  source 1..299: mol_type = other RNA
cgctcttccgcgtctcaagagggacatctcgcgatttcttgagtctaaccccgtgatgattgacgcccagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48548 - RNA, 299 nt, synthetic construct
  source 1..299: mol_type = other RNA
cgctcttccgcgtctcaagagggacatctcgcgatttcttgagtctaaccccgtgatgattgacgccaaacaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48549 - RNA, 299 nt, synthetic construct
  source 1..299: mol_type = other RNA
cgctcttccgcgtctcaagagggacatctcgcgatttcttgagtctaaccccgtgatgattgacgccaaagaacaggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48550 - RNA, 299 nt, synthetic construct
  source 1..299: mol_type = other RNA
cgctcttccgcgtctcaagagggacatctcgcgatttcttgagtctaaccccgtgatgattgacgccaaagaagtgcagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48551 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctcaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48552 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctcaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48553 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48554 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacaccagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48555 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggcaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48556 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48557 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtcagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48558 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttaccagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48559 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttccagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48560 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggcagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48561 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtcagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48562 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48563 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48564 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48565 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48566 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48567 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48568 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48569 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48570 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48571 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48572 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48573 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48574 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48575 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48576 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48577 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48578 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48579 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48580 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48581 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48582 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48583 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48584 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcaggagcacggcagaatagccaagttcagcaaagtgaggaccattaccaccaggtcaaactctataaagcagggcaaagaccagcatttccccgtcttcatgaacgagacgtcggaagagc

SEQ ID NO: 48585 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcagcacggcagaatagccaagttcagcaaagtgaggaccattaccaccaggtcaaactctataaagcagggcaaagaccagcatttccccgtcttcatgaacgagacgtcggaagagc

SEQ ID NO: 48586 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccagggcagaatagccaagttcagcaaagtgaggaccattaccaccaggtcaaactctataaagcagggcaaagaccagcatttccccgtcttcatgaacgagacgtcggaagagc

SEQ ID NO: 48587 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccagagaatagccaagttcagcaaagtgaggaccattaccaccaggtcaaactctataaagcagggcaaagaccagcatttccccgtcttcatgaacgagacgtcggaagagc

SEQ ID NO: 48588 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacagatagccaagttcagcaaagtgaggaccattaccaccaggtcaaactctataaagcagggcaaagaccagcatttccccgtcttcatgaacgagacgtcggaagagc

SEQ ID NO: 48589 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacaggccaagttcagcaaagtgaggaccattaccaccaggtcaaactctataaagcagggcaaagaccagcatttccccgtcttcatgaacgagacgtcggaagagc

SEQ ID NO: 48590 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccagaagttcagcaaagtgaggaccattaccaccaggtcaaactctataaagcagggcaaagaccagcatttccccgtcttcatgaacgagacgtcggaagagc

SEQ ID NO: 48591 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcagttcagcaaagtgaggaccattaccaccaggtcaaactctataaagcagggcaaagaccagcatttccccgtcttcatgaacgagacgtcggaagagc

SEQ ID NO: 48592 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccagagcaaagtgaggaccattaccaccaggtcaaactctataaagcagggcaaagaccagcatttccccgtcttcatgaacgagacgtcggaagagc

SEQ ID NO: 48593 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccagaaagtgaggaccattaccaccaggtcaaactctataaagcagggcaaagaccagcatttccccgtcttcatgaacgagacgtcggaagagc

SEQ ID NO: 48594 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacaggtgaggaccattaccaccaggtcaaactctataaagcagggcaaagaccagcatttccccgtcttcatgaacgagacgtcggaagagc

SEQ ID NO: 48595 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcagaggaccattaccaccaggtcaaactctataaagcagggcaaagaccagcatttccccgtcttcatgaacgagacgtcggaagagc

SEQ ID NO: 48596 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcagaccattaccaccaggtcaaactctataaagcagggcaaagaccagcatttccccgtcttcatgaacgagacgtcggaagagc

SEQ ID NO: 48597 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccagattaccaccaggtcaaactctataaagcagggcaaagaccagcatttccccgtcttcatgaacgagacgtcggaagagc

SEQ ID NO: 48598 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcagaccaccaggtcaaactctataaagcagggcaaagaccagcatttccccgtcttcatgaacgagacgtcggaagagc

SEQ ID NO: 48599 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccagaccaggtcaaactctataaagcagggcaaagaccagcatttccccgtcttcatgaacgagacgtcggaagagc

SEQ ID NO: 48600 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccagaggtcaaactctataaagcagggcaaagaccagcatttccccgtcttcatgaacgagacgtcggaagagc

SEQ ID NO: 48601 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcagtcaaactctataaagcagggcaaagaccagcatttccccgtcttcatgaacgagacgtcggaagagc

SEQ ID NO: 48602 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacagaactctataaagcagggcaaagaccagcatttccccgtcttcatgaacgagacgtcggaagagc

SEQ ID NO: 48603 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccagtctataaagcagggcaaagaccagcatttccccgtcttcatgaacgagacgtcggaagagc

SEQ ID NO: 48604 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcagataaagcagggcaaagaccagcatttccccgtcttcatgaacgagacgtcggaagagc

SEQ ID NO: 48605 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacagaagcagggcaaagaccagcatttccccgtcttcatgaacgagacgtcggaagagc

SEQ ID NO: 48606 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcagggcaaagaccagcatttccccgtcttcatgaacgagacgtcggaagagc

SEQ ID NO: 48607 - RNA, 299 nt, synthetic construct; identical to SEQ ID NO: 48606
  source 1..299: mol_type = other RNA

SEQ ID NO: 48608 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccagaaagaccagcatttccccgtcttcatgaacgagacgtcggaagagc

SEQ ID NO: 48609 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacaggaccagcatttccccgtcttcatgaacgagacgtcggaagagc

SEQ ID NO: 48610 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcagcatttccccgtcttcatgaacgagacgtcggaagagc

SEQ ID NO: 48611 - RNA, 299 nt, synthetic construct; identical to SEQ ID NO: 48610
  source 1..299: mol_type = other RNA

SEQ ID NO: 48612 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcagttccccgtcttcatgaacgagacgtcggaagagc

SEQ ID NO: 48613 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccagcccgtcttcatgaacgagacgtcggaagagc

SEQ ID NO: 48614 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccaggtcttcatgaacgagacgtcggaagagc

SEQ ID NO: 48615 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccagttcatgaacgagacgtcggaagagc

SEQ ID NO: 48616 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttccagatgaacgagacgtcggaagagc

SEQ ID NO: 48617 - RNA, 299 nt, synthetic construct
  source 1..299: mol_type = other RNA
cgctcttccgcgtctcaagagggaccacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48618 - RNA, 299 nt, synthetic construct
  source 1..299: mol_type = other RNA
cgctcttccgcgtctcaagagggacatccactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48619 - RNA, 299 nt, synthetic construct
  source 1..299: mol_type = other RNA
cgctcttccgcgtctcaagagggacatctcgcaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48620 - RNA, 299 nt, synthetic construct
  source 1..299: mol_type = other RNA
cgctcttccgcgtctcaagagggacatctcgcgacactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48621 - RNA, 299 nt, synthetic construct
  source 1..299: mol_type = other RNA
cgctcttccgcgtctcaagagggacatctcgcgatttcaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48622 - RNA, 299 nt, synthetic construct
  source 1..299: mol_type = other RNA
cgctcttccgcgtctcaagagggacatctcgcgatttcttcacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48623 - RNA, 299 nt, synthetic construct
  source 1..299: mol_type = other RNA
cgctcttccgcgtctcaagagggacatctcgcgatttcttgagcactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48624 - RNA, 299 nt, synthetic construct
  source 1..299: mol_type = other RNA
cgctcttccgcgtctcaagagggacatctcgcgatttcttgagtctcacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48625 - RNA, 299 nt, synthetic construct
  source 1..299: mol_type = other RNA
cgctcttccgcgtctcaagagggacatctcgcgatttcttgagtctaaccaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48626 - RNA, 299 nt, synthetic construct
  source 1..299: mol_type = other RNA
cgctcttccgcgtctcaagagggacatctcgcgatttcttgagtctaacccccacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48627 - RNA, 299 nt, synthetic construct
  source 1..299: mol_type = other RNA
cgctcttccgcgtctcaagagggacatctcgcgatttcttgagtctaaccccgtgcacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48628 - RNA, 299 nt, synthetic construct
  source 1..299: mol_type = other RNA
cgctcttccgcgtctcaagagggacatctcgcgatttcttgagtctaaccccgtgatgcacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48629 - RNA, 299 nt, synthetic construct
  source 1..299: mol_type = other RNA
cgctcttccgcgtctcaagagggacatctcgcgatttcttgagtctaaccccgtgatgattcacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48630 - RNA, 299 nt, synthetic construct
  source 1..299: mol_type = other RNA
cgctcttccgcgtctcaagagggacatctcgcgatttcttgagtctaaccccgtgatgattgaccacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48631 - RNA, 299 nt, synthetic construct
  source 1..299: mol_type = other RNA
cgctcttccgcgtctcaagagggacatctcgcgatttcttgagtctaaccccgtgatgattgacgcccacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48632 - RNA, 299 nt, synthetic construct
  source 1..299: mol_type = other RNA
cgctcttccgcgtctcaagagggacatctcgcgatttcttgagtctaaccccgtgatgattgacgccaaacacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48633 - RNA, 299 nt, synthetic construct
  source 1..299: mol_type = other RNA
cgctcttccgcgtctcaagagggacatctcgcgatttcttgagtctaaccccgtgatgattgacgccaaagaacacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48634 - RNA, 299 nt, synthetic construct
  source 1..299: mol_type = other RNA
cgctcttccgcgtctcaagagggacatctcgcgatttcttgagtctaaccccgtgatgattgacgccaaagaagtgcactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48635 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctcacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48636 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctcacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48637 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48638 - RNA, 299 nt, synthetic construct; identical to SEQ ID NO: 48637
  source 1..299: mol_type = other RNA

SEQ ID NO: 48639 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggcacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48640 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48641 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtcactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48642 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttaccacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48643 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttccactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48644 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggcacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48645 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtcacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48646 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48647 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48648 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48649 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48650 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48651 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48652 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48653 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48654 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48655 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48656 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48657 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48658 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48659 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48660 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48661 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48662 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48663 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48664 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48665 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48666 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48667 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48668 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcacgagcacggcagaatagccaagttcagcaaagtgaggaccattaccaccaggtcaaactctataaagcagggcaaagaccagcatttccccgtcttcatgaacgagacgtcggaagagc

SEQ ID NO: 48669 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccacggcagaatagccaagttcagcaaagtgaggaccattaccaccaggtcaaactctataaagcagggcaaagaccagcatttccccgtcttcatgaacgagacgtcggaagagc

SEQ ID NO: 48670 - RNA, 299 nt, synthetic construct; identical to SEQ ID NO: 48669
  source 1..299: mol_type = other RNA

SEQ ID NO: 48671 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccacagaatagccaagttcagcaaagtgaggaccattaccaccaggtcaaactctataaagcagggcaaagaccagcatttccccgtcttcatgaacgagacgtcggaagagc

SEQ ID NO: 48672 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacacatagccaagttcagcaaagtgaggaccattaccaccaggtcaaactctataaagcagggcaaagaccagcatttccccgtcttcatgaacgagacgtcggaagagc

SEQ ID NO: 48673 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacacgccaagttcagcaaagtgaggaccattaccaccaggtcaaactctataaagcagggcaaagaccagcatttccccgtcttcatgaacgagacgtcggaagagc

SEQ ID NO: 48674 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccacaagttcagcaaagtgaggaccattaccaccaggtcaaactctataaagcagggcaaagaccagcatttccccgtcttcatgaacgagacgtcggaagagc

SEQ ID NO: 48675 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcacttcagcaaagtgaggaccattaccaccaggtcaaactctataaagcagggcaaagaccagcatttccccgtcttcatgaacgagacgtcggaagagc

SEQ ID NO: 48676 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccacagcaaagtgaggaccattaccaccaggtcaaactctataaagcagggcaaagaccagcatttccccgtcttcatgaacgagacgtcggaagagc

SEQ ID NO: 48677 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccacaaagtgaggaccattaccaccaggtcaaactctataaagcagggcaaagaccagcatttccccgtcttcatgaacgagacgtcggaagagc

SEQ ID NO: 48678 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacacgtgaggaccattaccaccaggtcaaactctataaagcagggcaaagaccagcatttccccgtcttcatgaacgagacgtcggaagagc

SEQ ID NO: 48679 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcacaggaccattaccaccaggtcaaactctataaagcagggcaaagaccagcatttccccgtcttcatgaacgagacgtcggaagagc

SEQ ID NO: 48680 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcacaccattaccaccaggtcaaactctataaagcagggcaaagaccagcatttccccgtcttcatgaacgagacgtcggaagagc

SEQ ID NO: 48681 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccacattaccaccaggtcaaactctataaagcagggcaaagaccagcatttccccgtcttcatgaacgagacgtcggaagagc

SEQ ID NO: 48682 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcacaccaccaggtcaaactctataaagcagggcaaagaccagcatttccccgtcttcatgaacgagacgtcggaagagc

SEQ ID NO: 48683 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccacaccaggtcaaactctataaagcagggcaaagaccagcatttccccgtcttcatgaacgagacgtcggaagagc

SEQ ID NO: 48684 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccacaggtcaaactctataaagcagggcaaagaccagcatttccccgtcttcatgaacgagacgtcggaagagc

SEQ ID NO: 48685 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcactcaaactctataaagcagggcaaagaccagcatttccccgtcttcatgaacgagacgtcggaagagc

SEQ ID NO: 48686 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacacaactctataaagcagggcaaagaccagcatttccccgtcttcatgaacgagacgtcggaagagc

SEQ ID NO: 48687 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccactctataaagcagggcaaagaccagcatttccccgtcttcatgaacgagacgtcggaagagc

SEQ ID NO: 48688 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcacataaagcagggcaaagaccagcatttccccgtcttcatgaacgagacgtcggaagagc

SEQ ID NO: 48689 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacacaagcagggcaaagaccagcatttccccgtcttcatgaacgagacgtcggaagagc

SEQ ID NO: 48690 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaccagggcaaagaccagcatttccccgtcttcatgaacgagacgtcggaagagc

SEQ ID NO: 48691 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcacggcaaagaccagcatttccccgtcttcatgaacgagacgtcggaagagc

SEQ ID NO: 48692 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccacaaagaccagcatttccccgtcttcatgaacgagacgtcggaagagc

SEQ ID NO: 48693 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacacgaccagcatttccccgtcttcatgaacgagacgtcggaagagc

SEQ ID NO: 48694 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaccagcatttccccgtcttcatgaacgagacgtcggaagagc

SEQ ID NO: 48695 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcaccatttccccgtcttcatgaacgagacgtcggaagagc

SEQ ID NO: 48696 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcacttccccgtcttcatgaacgagacgtcggaagagc

SEQ ID NO: 48697 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccaccccgtcttcatgaacgagacgtcggaagagc

SEQ ID NO: 48698 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccacgtcttcatgaacgagacgtcggaagagc

SEQ ID NO: 48699 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccacttcatgaacgagacgtcggaagagc

SEQ ID NO: 48700 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttccacatgaacgagacgtcggaagagc

SEQ ID NO: 48701 - RNA, 299 nt, synthetic construct
  source 1..299: mol_type = other RNA
cgctcttccgcgtctcaagagggacctgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48702 - RNA, 299 nt, synthetic construct
  source 1..299: mol_type = other RNA
cgctcttccgcgtctcaagagggacatcctgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48703 - RNA, 299 nt, synthetic construct
  source 1..299: mol_type = other RNA
cgctcttccgcgtctcaagagggacatctcgctgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48704 - RNA, 299 nt, synthetic construct
  source 1..299: mol_type = other RNA
cgctcttccgcgtctcaagagggacatctcgcgactgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48705 - RNA, 299 nt, synthetic construct
  source 1..299: mol_type = other RNA
cgctcttccgcgtctcaagagggacatctcgcgatttctgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48706 - RNA, 299 nt, synthetic construct
  source 1..299: mol_type = other RNA
cgctcttccgcgtctcaagagggacatctcgcgatttcttctggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48707 - RNA, 299 nt, synthetic construct
  source 1..299: mol_type = other RNA
cgctcttccgcgtctcaagagggacatctcgcgatttcttgagctgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48708 - RNA, 299 nt, synthetic construct
  source 1..299: mol_type = other RNA
cgctcttccgcgtctcaagagggacatctcgcgatttcttgagtctctgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48709 - RNA, 299 nt, synthetic construct
  source 1..299: mol_type = other RNA
cgctcttccgcgtctcaagagggacatctcgcgatttcttgagtctaacctgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48710 - RNA, 299 nt, synthetic construct
  source 1..299: mol_type = other RNA
cgctcttccgcgtctcaagagggacatctcgcgatttcttgagtctaaccccctggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48711 - RNA, 299 nt, synthetic construct
  source 1..299: mol_type = other RNA
cgctcttccgcgtctcaagagggacatctcgcgatttcttgagtctaaccccgtgctgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48712 - RNA, 299 nt, synthetic construct
  source 1..299: mol_type = other RNA
cgctcttccgcgtctcaagagggacatctcgcgatttcttgagtctaaccccgtgatgctgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48713 - RNA, 299 nt, synthetic construct
  source 1..299: mol_type = other RNA
cgctcttccgcgtctcaagagggacatctcgcgatttcttgagtctaaccccgtgatgattctggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48714 - RNA, 299 nt, synthetic construct
  source 1..299: mol_type = other RNA
cgctcttccgcgtctcaagagggacatctcgcgatttcttgagtctaaccccgtgatgattgacctggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48715 - RNA, 299 nt, synthetic construct
  source 1..299: mol_type = other RNA
cgctcttccgcgtctcaagagggacatctcgcgatttcttgagtctaaccccgtgatgattgacgccctgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48716 - RNA, 299 nt, synthetic construct
  source 1..299: mol_type = other RNA
cgctcttccgcgtctcaagagggacatctcgcgatttcttgagtctaaccccgtgatgattgacgccaaactggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48717 - RNA, 299 nt, synthetic construct
  source 1..299: mol_type = other RNA
cgctcttccgcgtctcaagagggacatctcgcgatttcttgagtctaaccccgtgatgattgacgccaaagaactggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48718 - RNA, 299 nt, synthetic construct
  source 1..299: mol_type = other RNA
cgctcttccgcgtctcaagagggacatctcgcgatttcttgagtctaaccccgtgatgattgacgccaaagaagtgctgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48719 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctctggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48720 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctctggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48721 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcactgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48722 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacctgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48723 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggctggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48724 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccctgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48725 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtctgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48726 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacctgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48727 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcctgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48728 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggctgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48729 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtctgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48730 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48731 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttctgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48732 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctctgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48733 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcctgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48734 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgctgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48735 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacctgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48736 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggctgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48737 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctctgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48738 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgctggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48739 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcactgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48740 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccctgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48741 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactctggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48742 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgctgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48743 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatctggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48744 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatctgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48745 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48746 - RNA, 299 nt, synthetic construct; identical to SEQ ID NO: 48745
  source 1..299: mol_type = other RNA

SEQ ID NO: 48747 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48748 - RNA, 299 nt, synthetic construct; identical to SEQ ID NO: 48747
  source 1..299: mol_type = other RNA

SEQ ID NO: 48749 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaactggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48750 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagctgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48751 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48752 - RNA, 299 nt, synthetic construct; identical to SEQ ID NO: 48751
  source 1..299: mol_type = other RNA

SEQ ID NO: 48753 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagctgcacggcagaatagccaagttcagcaaagtgaggaccattaccaccaggtcaaactctataaagcagggcaaagaccagcatttccccgtcttcatgaacgagacgtcggaagagc

SEQ ID NO: 48754 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacctgggcagaatagccaagttcagcaaagtgaggaccattaccaccaggtcaaactctataaagcagggcaaagaccagcatttccccgtcttcatgaacgagacgtcggaagagc

SEQ ID NO: 48755 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcctgagaatagccaagttcagcaaagtgaggaccattaccaccaggtcaaactctataaagcagggcaaagaccagcatttccccgtcttcatgaacgagacgtcggaagagc

SEQ ID NO: 48756 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagactgatagccaagttcagcaaagtgaggaccattaccaccaggtcaaactctataaagcagggcaaagaccagcatttccccgtcttcatgaacgagacgtcggaagagc

SEQ ID NO: 48757 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatactggccaagttcagcaaagtgaggaccattaccaccaggtcaaactctataaagcagggcaaagaccagcatttccccgtcttcatgaacgagacgtcggaagagc

SEQ ID NO: 48758 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccctgaagttcagcaaagtgaggaccattaccaccaggtcaaactctataaagcagggcaaagaccagcatttccccgtcttcatgaacgagacgtcggaagagc

SEQ ID NO: 48759 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagctgttcagcaaagtgaggaccattaccaccaggtcaaactctataaagcagggcaaagaccagcatttccccgtcttcatgaacgagacgtcggaagagc

SEQ ID NO: 48760 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcctgagcaaagtgaggaccattaccaccaggtcaaactctataaagcagggcaaagaccagcatttccccgtcttcatgaacgagacgtcggaagagc

SEQ ID NO: 48761 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcctgaaagtgaggaccattaccaccaggtcaaactctataaagcagggcaaagaccagcatttccccgtcttcatgaacgagacgtcggaagagc

SEQ ID NO: 48762 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaactggtgaggaccattaccaccaggtcaaactctataaagcagggcaaagaccagcatttccccgtcttcatgaacgagacgtcggaagagc

SEQ ID NO: 48763 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgctgaggaccattaccaccaggtcaaactctataaagcagggcaaagaccagcatttccccgtcttcatgaacgagacgtcggaagagc

SEQ ID NO: 48764 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggctgaccattaccaccaggtcaaactctataaagcagggcaaagaccagcatttccccgtcttcatgaacgagacgtcggaagagc

SEQ ID NO: 48765 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccctgattaccaccaggtcaaactctataaagcagggcaaagaccagcatttccccgtcttcatgaacgagacgtcggaagagc

SEQ ID NO: 48766 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattctgaccaccaggtcaaactctataaagcagggcaaagaccagcatttccccgtcttcatgaacgagacgtcggaagagc

SEQ ID NO: 48767 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccctgaccaggtcaaactctataaagcagggcaaagaccagcatttccccgtcttcatgaacgagacgtcggaagagc

SEQ ID NO: 48768 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccctgaggtcaaactctataaagcagggcaaagaccagcatttccccgtcttcatgaacgagacgtcggaagagc

SEQ ID NO: 48769 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggctgtcaaactctataaagcagggcaaagaccagcatttccccgtcttcatgaacgagacgtcggaagagc

SEQ ID NO: 48770 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcactgaactctataaagcagggcaaagaccagcatttccccgtcttcatgaacgagacgtcggaagagc

SEQ ID NO: 48771 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacctgtctataaagcagggcaaagaccagcatttccccgtcttcatgaacgagacgtcggaagagc

SEQ ID NO: 48772 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctctgataaagcagggcaaagaccagcatttccccgtcttcatgaacgagacgtcggaagagc

SEQ ID NO: 48773 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatactgaagcagggcaaagaccagcatttccccgtcttcatgaacgagacgtcggaagagc

SEQ ID NO: 48774 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagctgcagggcaaagaccagcatttccccgtcttcatgaacgagacgtcggaagagc

SEQ ID NO: 48775 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagctgggcaaagaccagcatttccccgtcttcatgaacgagacgtcggaagagc

SEQ ID NO: 48776 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcctgaaagaccagcatttccccgtcttcatgaacgagacgtcggaagagc

SEQ ID NO: 48777 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaactggaccagcatttccccgtcttcatgaacgagacgtcggaagagc

SEQ ID NO: 48778 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacctgcagcatttccccgtcttcatgaacgagacgtcggaagagc

SEQ ID NO: 48779 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagctgcatttccccgtcttcatgaacgagacgtcggaagagc

SEQ ID NO: 48780 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatctgttccccgtcttcatgaacgagacgtcggaagagc

SEQ ID NO: 48781 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcctgcccgtcttcatgaacgagacgtcggaagagc

SEQ ID NO: 48782 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccctggtcttcatgaacgagacgtcggaagagc

SEQ ID NO: 48783 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcctgttcatgaacgagacgtcggaagagc

SEQ ID NO: 48784 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcctgatgaacgagacgtcggaagagc

SEQ ID NO: 48785 - RNA, 299 nt, synthetic construct
  source 1..299: mol_type = other RNA
cgctcttccgcgtctcaagagggacctcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48786 - RNA, 299 nt, synthetic construct
  source 1..299: mol_type = other RNA
cgctcttccgcgtctcaagagggacatcctctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48787 - RNA, 299 nt, synthetic construct
  source 1..299: mol_type = other RNA
cgctcttccgcgtctcaagagggacatctcgctccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48788 - RNA, 299 nt, synthetic construct
  source 1..299: mol_type = other RNA
cgctcttccgcgtctcaagagggacatctcgcgactctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48789 - RNA, 299 nt, synthetic construct
  source 1..299: mol_type = other RNA
cgctcttccgcgtctcaagagggacatctcgcgatttctccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48790 - RNA, 299 nt, synthetic construct
  source 1..299: mol_type = other RNA
cgctcttccgcgtctcaagagggacatctcgcgatttcttctcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48791 - RNA, 299 nt, synthetic construct
  source 1..299: mol_type = other RNA
cgctcttccgcgtctcaagagggacatctcgcgatttcttgagctctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48792 - RNA, 299 nt, synthetic construct
  source 1..299: mol_type = other RNA
cgctcttccgcgtctcaagagggacatctcgcgatttcttgagtctctcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48793 - RNA, 299 nt, synthetic construct
  source 1..299: mol_type = other RNA
cgctcttccgcgtctcaagagggacatctcgcgatttcttgagtctaacctccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48794 - RNA, 299 nt, synthetic construct
  source 1..299: mol_type = other RNA
cgctcttccgcgtctcaagagggacatctcgcgatttcttgagtctaaccccctcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48795 - RNA, 299 nt, synthetic construct
  source 1..299: mol_type = other RNA
cgctcttccgcgtctcaagagggacatctcgcgatttcttgagtctaaccccgtgctcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48796 - RNA, 299 nt, synthetic construct
  source 1..299: mol_type = other RNA
cgctcttccgcgtctcaagagggacatctcgcgatttcttgagtctaaccccgtgatgctcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48797 - RNA, 299 nt, synthetic construct
  source 1..299: mol_type = other RNA
cgctcttccgcgtctcaagagggacatctcgcgatttcttgagtctaaccccgtgatgattctcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48798 - RNA, 299 nt, synthetic construct
  source 1..299: mol_type = other RNA
cgctcttccgcgtctcaagagggacatctcgcgatttcttgagtctaaccccgtgatgattgacctcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48799 - RNA, 299 nt, synthetic construct
  source 1..299: mol_type = other RNA
cgctcttccgcgtctcaagagggacatctcgcgatttcttgagtctaaccccgtgatgattgacgccctcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48800 - RNA, 299 nt, synthetic construct
  source 1..299: mol_type = other RNA
cgctcttccgcgtctcaagagggacatctcgcgatttcttgagtctaaccccgtgatgattgacgccaaactcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48801 - RNA, 299 nt, synthetic construct
  source 1..299: mol_type = other RNA
cgctcttccgcgtctcaagagggacatctcgcgatttcttgagtctaaccccgtgatgattgacgccaaagaactcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48802 - RNA, 299 nt, synthetic construct
  source 1..299: mol_type = other RNA
cgctcttccgcgtctcaagagggacatctcgcgatttcttgagtctaaccccgtgatgattgacgccaaagaagtgctctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48803 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctctcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48804 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctctcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48805 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcactccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48806 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacctcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48807 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggctcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48808 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccctccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48809 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtctctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48810 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacctcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48811 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcctctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48812 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggctcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48813 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtctcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48814 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacctccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48815 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttctccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48816 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctctcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48817 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcctcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48818 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgctcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48819 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacctcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48820 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggctccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48821 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctctcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48822 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgctcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48823 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcactctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48824 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccctcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48825 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactctcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48826 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgctcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48827 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatctcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48828 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatctcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48829 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48830 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgctcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48831 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48832 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgctccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48833 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaactcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48834 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagctctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48835 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48836 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgctcgagcacggcagaatagccaagttcagcaaagtgaggaccattaccaccaggtcaaactctataaagcagggcaaagaccagcatttccccgtcttcatgaacgagacgtcggaagagc

SEQ ID NO: 48837 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagctccacggcagaatagccaagttcagcaaagtgaggaccattaccaccaggtcaaactctataaagcagggcaaagaccagcatttccccgtcttcatgaacgagacgtcggaagagc

SEQ ID NO: 48838 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacctcggcagaatagccaagttcagcaaagtgaggaccattaccaccaggtcaaactctataaagcagggcaaagaccagcatttccccgtcttcatgaacgagacgtcggaagagc

SEQ ID NO: 48839 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcctcagaatagccaagttcagcaaagtgaggaccattaccaccaggtcaaactctataaagcagggcaaagaccagcatttccccgtcttcatgaacgagacgtcggaagagc

SEQ ID NO: 48840 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagactcatagccaagttcagcaaagtgaggaccattaccaccaggtcaaactctataaagcagggcaaagaccagcatttccccgtcttcatgaacgagacgtcggaagagc

SEQ ID NO: 48841 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatactcgccaagttcagcaaagtgaggaccattaccaccaggtcaaactctataaagcagggcaaagaccagcatttccccgtcttcatgaacgagacgtcggaagagc

SEQ ID NO: 48842 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccctcaagttcagcaaagtgaggaccattaccaccaggtcaaactctataaagcagggcaaagaccagcatttccccgtcttcatgaacgagacgtcggaagagc

SEQ ID NO: 48843 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagctcttcagcaaagtgaggaccattaccaccaggtcaaactctataaagcagggcaaagaccagcatttccccgtcttcatgaacgagacgtcggaagagc

SEQ ID NO: 48844 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcctcagcaaagtgaggaccattaccaccaggtcaaactctataaagcagggcaaagaccagcatttccccgtcttcatgaacgagacgtcggaagagc

SEQ ID NO: 48845 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcctcaaagtgaggaccattaccaccaggtcaaactctataaagcagggcaaagaccagcatttccccgtcttcatgaacgagacgtcggaagagc

SEQ ID NO: 48846 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaactcgtgaggaccattaccaccaggtcaaactctataaagcagggcaaagaccagcatttccccgtcttcatgaacgagacgtcggaagagc

SEQ ID NO: 48847 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgctcaggaccattaccaccaggtcaaactctataaagcagggcaaagaccagcatttccccgtcttcatgaacgagacgtcggaagagc

SEQ ID NO: 48848 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggctcaccattaccaccaggtcaaactctataaagcagggcaaagaccagcatttccccgtcttcatgaacgagacgtcggaagagc

SEQ ID NO: 48849 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccctcattaccaccaggtcaaactctataaagcagggcaaagaccagcatttccccgtcttcatgaacgagacgtcggaagagc

SEQ ID NO: 48850 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattctcaccaccaggtcaaactctataaagcagggcaaagaccagcatttccccgtcttcatgaacgagacgtcggaagagc

SEQ ID NO: 48851 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccctcaccaggtcaaactctataaagcagggcaaagaccagcatttccccgtcttcatgaacgagacgtcggaagagc

SEQ ID NO: 48852 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccctcaggtcaaactctataaagcagggcaaagaccagcatttccccgtcttcatgaacgagacgtcggaagagc

SEQ ID NO: 48853 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggctctcaaactctataaagcagggcaaagaccagcatttccccgtcttcatgaacgagacgtcggaagagc

SEQ ID NO: 48854 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcactcaactctataaagcagggcaaagaccagcatttccccgtcttcatgaacgagacgtcggaagagc

SEQ ID NO: 48855 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacctctctataaagcagggcaaagaccagcatttccccgtcttcatgaacgagacgtcggaagagc

SEQ ID NO: 48856 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctctcataaagcagggcaaagaccagcatttccccgtcttcatgaacgagacgtcggaagagc

SEQ ID NO: 48857 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatactcaagcagggcaaagaccagcatttccccgtcttcatgaacgagacgtcggaagagc

SEQ ID NO: 48858 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagctccagggcaaagaccagcatttccccgtcttcatgaacgagacgtcggaagagc

SEQ ID NO: 48859 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagctcggcaaagaccagcatttccccgtcttcatgaacgagacgtcggaagagc

SEQ ID NO: 48860 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcctcaaagaccagcatttccccgtcttcatgaacgagacgtcggaagagc

SEQ ID NO: 48861 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaactcgaccagcatttccccgtcttcatgaacgagacgtcggaagagc

SEQ ID NO: 48862 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacctccagcatttccccgtcttcatgaacgagacgtcggaagagc

SEQ ID NO: 48863 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagctccatttccccgtcttcatgaacgagacgtcggaagagc

SEQ ID NO: 48864 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatctcttccccgtcttcatgaacgagacgtcggaagagc

SEQ ID NO: 48865 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcctccccgtcttcatgaacgagacgtcggaagagc

SEQ ID NO: 48866 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccctcgtcttcatgaacgagacgtcggaagagc

SEQ ID NO: 48867 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcctcttcatgaacgagacgtcggaagagc

SEQ ID NO: 48868 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcctcatgaacgagacgtcggaagagc

SEQ ID NO: 48869 - RNA, 299 nt, synthetic construct
  source 1..299: mol_type = other RNA
cgctcttccgcgtctcaagagggaccggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48870 - RNA, 299 nt, synthetic construct
  source 1..299: mol_type = other RNA
cgctcttccgcgtctcaagagggacatccggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48871 - RNA, 299 nt, synthetic construct
  source 1..299: mol_type = other RNA
cgctcttccgcgtctcaagagggacatctcgcggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48872 - RNA, 299 nt, synthetic construct
  source 1..299: mol_type = other RNA
cgctcttccgcgtctcaagagggacatctcgcgacggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48873 - RNA, 299 nt, synthetic construct
  source 1..299: mol_type = other RNA
cgctcttccgcgtctcaagagggacatctcgcgatttcggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48874 - RNA, 299 nt, synthetic construct
  source 1..299: mol_type = other RNA
cgctcttccgcgtctcaagagggacatctcgcgatttcttcgggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48875 - RNA, 299 nt, synthetic construct
  source 1..299: mol_type = other RNA
cgctcttccgcgtctcaagagggacatctcgcgatttcttgagcggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48876 - RNA, 299 nt, synthetic construct
  source 1..299: mol_type = other RNA
cgctcttccgcgtctcaagagggacatctcgcgatttcttgagtctcggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48877 - RNA, 299 nt, synthetic construct
  source 1..299: mol_type = other RNA
cgctcttccgcgtctcaagagggacatctcgcgatttcttgagtctaaccggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48878 - RNA, 299 nt, synthetic construct
  source 1..299: mol_type = other RNA
cgctcttccgcgtctcaagagggacatctcgcgatttcttgagtctaacccccgggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48879 - RNA, 299 nt, synthetic construct
  source 1..299: mol_type = other RNA
cgctcttccgcgtctcaagagggacatctcgcgatttcttgagtctaaccccgtgcggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48880 - RNA, 299 nt, synthetic construct
  source 1..299: mol_type = other RNA
cgctcttccgcgtctcaagagggacatctcgcgatttcttgagtctaaccccgtgatgcggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48881 - RNA, 299 nt, synthetic construct
  source 1..299: mol_type = other RNA
cgctcttccgcgtctcaagagggacatctcgcgatttcttgagtctaaccccgtgatgattcgggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48882 - RNA, 299 nt, synthetic construct
  source 1..299: mol_type = other RNA
cgctcttccgcgtctcaagagggacatctcgcgatttcttgagtctaaccccgtgatgattgaccgggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48883 - RNA, 299 nt, synthetic construct
  source 1..299: mol_type = other RNA
cgctcttccgcgtctcaagagggacatctcgcgatttcttgagtctaaccccgtgatgattgacgcccggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48884 - RNA, 299 nt, synthetic construct
  source 1..299: mol_type = other RNA
cgctcttccgcgtctcaagagggacatctcgcgatttcttgagtctaaccccgtgatgattgacgccaaacgggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48885 - RNA, 299 nt, synthetic construct
  source 1..299: mol_type = other RNA
cgctcttccgcgtctcaagagggacatctcgcgatttcttgagtctaaccccgtgatgattgacgccaaagaacgggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48886 - RNA, 299 nt, synthetic construct
  source 1..299: mol_type = other RNA
cgctcttccgcgtctcaagagggacatctcgcgatttcttgagtctaaccccgtgatgattgacgccaaagaagtgcggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48887 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctcgggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48888 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctcgggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48889 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48890 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacaccggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48891 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggcgggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48892 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48893 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtcggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48894 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttaccggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48895 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttccggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48896 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggcggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48897 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtcggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48898 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48899 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48900 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48901 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48902 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48903 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48904 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48905 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48906 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcgggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48907 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48908 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48909 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcgggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48910 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48911 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcgggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48912 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48913 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48914 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcgggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48915 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48916 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48917 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacgggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48918 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48919 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48920 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcgggagcacggcagaatagccaagttcagcaaagtgaggaccattaccaccaggtcaaactctataaagcagggcaaagaccagcatttccccgtcttcatgaacgagacgtcggaagagc

SEQ ID NO: 48921 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcggcacggcagaatagccaagttcagcaaagtgaggaccattaccaccaggtcaaactctataaagcagggcaaagaccagcatttccccgtcttcatgaacgagacgtcggaagagc

SEQ ID NO: 48922 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccggggcagaatagccaagttcagcaaagtgaggaccattaccaccaggtcaaactctataaagcagggcaaagaccagcatttccccgtcttcatgaacgagacgtcggaagagc

SEQ ID NO: 48923 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccggagaatagccaagttcagcaaagtgaggaccattaccaccaggtcaaactctataaagcagggcaaagaccagcatttccccgtcttcatgaacgagacgtcggaagagc

SEQ ID NO: 48924 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacggatagccaagttcagcaaagtgaggaccattaccaccaggtcaaactctataaagcagggcaaagaccagcatttccccgtcttcatgaacgagacgtcggaagagc

SEQ ID NO: 48925 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacgggccaagttcagcaaagtgaggaccattaccaccaggtcaaactctataaagcagggcaaagaccagcatttccccgtcttcatgaacgagacgtcggaagagc

SEQ ID NO: 48926 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccggaagttcagcaaagtgaggaccattaccaccaggtcaaactctataaagcagggcaaagaccagcatttccccgtcttcatgaacgagacgtcggaagagc

SEQ ID NO: 48927 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcggttcagcaaagtgaggaccattaccaccaggtcaaactctataaagcagggcaaagaccagcatttccccgtcttcatgaacgagacgtcggaagagc

SEQ ID NO: 48928 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccggagcaaagtgaggaccattaccaccaggtcaaactctataaagcagggcaaagaccagcatttccccgtcttcatgaacgagacgtcggaagagc

SEQ ID NO: 48929 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccggaaagtgaggaccattaccaccaggtcaaactctataaagcagggcaaagaccagcatttccccgtcttcatgaacgagacgtcggaagagc

SEQ ID NO: 48930 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacgggtgaggaccattaccaccaggtcaaactctataaagcagggcaaagaccagcatttccccgtcttcatgaacgagacgtcggaagagc

SEQ ID NO: 48931 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcggaggaccattaccaccaggtcaaactctataaagcagggcaaagaccagcatttccccgtcttcatgaacgagacgtcggaagagc

SEQ ID NO: 48932 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcggaccattaccaccaggtcaaactctataaagcagggcaaagaccagcatttccccgtcttcatgaacgagacgtcggaagagc

SEQ ID NO: 48933 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccggattaccaccaggtcaaactctataaagcagggcaaagaccagcatttccccgtcttcatgaacgagacgtcggaagagc

SEQ ID NO: 48934 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcggaccaccaggtcaaactctataaagcagggcaaagaccagcatttccccgtcttcatgaacgagacgtcggaagagc

SEQ ID NO: 48935 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccggaccaggtcaaactctataaagcagggcaaagaccagcatttccccgtcttcatgaacgagacgtcggaagagc

SEQ ID NO: 48936 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccggaggtcaaactctataaagcagggcaaagaccagcatttccccgtcttcatgaacgagacgtcggaagagc

SEQ ID NO: 48937 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcggtcaaactctataaagcagggcaaagaccagcatttccccgtcttcatgaacgagacgtcggaagagc

SEQ ID NO: 48938 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacggaactctataaagcagggcaaagaccagcatttccccgtcttcatgaacgagacgtcggaagagc

SEQ ID NO: 48939 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccggtctataaagcagggcaaagaccagcatttccccgtcttcatgaacgagacgtcggaagagc

SEQ ID NO: 48940 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcggataaagcagggcaaagaccagcatttccccgtcttcatgaacgagacgtcggaagagc

SEQ ID NO: 48941 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacggaagcagggcaaagaccagcatttccccgtcttcatgaacgagacgtcggaagagc

SEQ ID NO: 48942 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcggcagggcaaagaccagcatttccccgtcttcatgaacgagacgtcggaagagc

SEQ ID NO: 48943 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcggggcaaagaccagcatttccccgtcttcatgaacgagacgtcggaagagc

SEQ ID NO: 48944 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccggaaagaccagcatttccccgtcttcatgaacgagacgtcggaagagc

SEQ ID NO: 48945 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacgggaccagcatttccccgtcttcatgaacgagacgtcggaagagc

SEQ ID NO: 48946 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccggcagcatttccccgtcttcatgaacgagacgtcggaagagc

SEQ ID NO: 48947 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcggcatttccccgtcttcatgaacgagacgtcggaagagc

SEQ ID NO: 48948 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcggttccccgtcttcatgaacgagacgtcggaagagc

SEQ ID NO: 48949 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccggcccgtcttcatgaacgagacgtcggaagagc

SEQ ID NO: 48950 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccgggtcttcatgaacgagacgtcggaagagc

SEQ ID NO: 48951 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccggttcatgaacgagacgtcggaagagc

SEQ ID NO: 48952 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttccggatgaacgagacgtcggaagagc

SEQ ID NO: 48953 - RNA, 299 nt, synthetic construct
  source 1..299: mol_type = other RNA
cgctcttccgcgtctcaagagggaccgcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48954 - RNA, 299 nt, synthetic construct
  source 1..299: mol_type = other RNA
cgctcttccgcgtctcaagagggacatccgctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48955 - RNA, 299 nt, synthetic construct
  source 1..299: mol_type = other RNA
cgctcttccgcgtctcaagagggacatctcgcgccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48956 - RNA, 299 nt, synthetic construct
  source 1..299: mol_type = other RNA
cgctcttccgcgtctcaagagggacatctcgcgacgctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48957 - RNA, 299 nt, synthetic construct
  source 1..299: mol_type = other RNA
cgctcttccgcgtctcaagagggacatctcgcgatttcgccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48958 - RNA, 299 nt, synthetic construct
  source 1..299: mol_type = other RNA
cgctcttccgcgtctcaagagggacatctcgcgatttcttcgcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48959 - RNA, 299 nt, synthetic construct
  source 1..299: mol_type = other RNA
cgctcttccgcgtctcaagagggacatctcgcgatttcttgagcgctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48960 - RNA, 299 nt, synthetic construct
  source 1..299: mol_type = other RNA
cgctcttccgcgtctcaagagggacatctcgcgatttcttgagtctcgcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48961 - RNA, 299 nt, synthetic construct
  source 1..299: mol_type = other RNA
cgctcttccgcgtctcaagagggacatctcgcgatttcttgagtctaaccgccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48962 - RNA, 299 nt, synthetic construct
  source 1..299: mol_type = other RNA
cgctcttccgcgtctcaagagggacatctcgcgatttcttgagtctaacccccgcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48963 - RNA, 299 nt, synthetic construct
  source 1..299: mol_type = other RNA
cgctcttccgcgtctcaagagggacatctcgcgatttcttgagtctaaccccgtgcgcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48964 - RNA, 299 nt, synthetic construct
  source 1..299: mol_type = other RNA
cgctcttccgcgtctcaagagggacatctcgcgatttcttgagtctaaccccgtgatgcgcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48965 - RNA, 299 nt, synthetic construct
  source 1..299: mol_type = other RNA
cgctcttccgcgtctcaagagggacatctcgcgatttcttgagtctaaccccgtgatgattcgcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48966 - RNA, 299 nt, synthetic construct
  source 1..299: mol_type = other RNA
cgctcttccgcgtctcaagagggacatctcgcgatttcttgagtctaaccccgtgatgattgaccgcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48967 - RNA, 299 nt, synthetic construct
  source 1..299: mol_type = other RNA
cgctcttccgcgtctcaagagggacatctcgcgatttcttgagtctaaccccgtgatgattgacgcccgcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48968 - RNA, 299 nt, synthetic construct
  source 1..299: mol_type = other RNA
cgctcttccgcgtctcaagagggacatctcgcgatttcttgagtctaaccccgtgatgattgacgccaaacgcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48969 - RNA, 299 nt, synthetic construct
  source 1..299: mol_type = other RNA
cgctcttccgcgtctcaagagggacatctcgcgatttcttgagtctaaccccgtgatgattgacgccaaagaacgcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48970 - RNA, 299 nt, synthetic construct
  source 1..299: mol_type = other RNA
cgctcttccgcgtctcaagagggacatctcgcgatttcttgagtctaaccccgtgatgattgacgccaaagaagtgcgctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48971 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctcgcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48972 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctcgcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48973 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacgccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48974 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacaccgcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48975 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggcgcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48976 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48977 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtcgctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48978 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttaccgcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48979 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttccgctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48980 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggcgcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48981 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtcgcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48982 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccgccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48983 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcgccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48984 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcgcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48985 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccgcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48986 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcgcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48987 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccgcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48988 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcgccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48989 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcgcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48990 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcgcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48991 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacgctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48992 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccgcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48993 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcgcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48994 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcgcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48995 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcgcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48996 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcgcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48997 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcgcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48998 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcgcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 48999 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcgcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49000 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcgccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49001 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacgcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49002 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcgctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49003 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcgcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49004 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcgcgagcacggcagaatagccaagttcagcaaagtgaggaccattaccaccaggtcaaactctataaagcagggcaaagaccagcatttccccgtcttcatgaacgagacgtcggaagagc

SEQ ID NO: 49005 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcgccacggcagaatagccaagttcagcaaagtgaggaccattaccaccaggtcaaactctataaagcagggcaaagaccagcatttccccgtcttcatgaacgagacgtcggaagagc

SEQ ID NO: 49006 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccgcggcagaatagccaagttcagcaaagtgaggaccattaccaccaggtcaaactctataaagcagggcaaagaccagcatttccccgtcttcatgaacgagacgtcggaagagc

SEQ ID NO: 49007 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccgcagaatagccaagttcagcaaagtgaggaccattaccaccaggtcaaactctataaagcagggcaaagaccagcatttccccgtcttcatgaacgagacgtcggaagagc

SEQ ID NO: 49008 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacgcatagccaagttcagcaaagtgaggaccattaccaccaggtcaaactctataaagcagggcaaagaccagcatttccccgtcttcatgaacgagacgtcggaagagc

SEQ ID NO: 49009 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacgcgccaagttcagcaaagtgaggaccattaccaccaggtcaaactctataaagcagggcaaagaccagcatttccccgtcttcatgaacgagacgtcggaagagc

SEQ ID NO: 49010 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccgcaagttcagcaaagtgaggaccattaccaccaggtcaaactctataaagcagggcaaagaccagcatttccccgtcttcatgaacgagacgtcggaagagc

SEQ ID NO: 49011 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcgcttcagcaaagtgaggaccattaccaccaggtcaaactctataaagcagggcaaagaccagcatttccccgtcttcatgaacgagacgtcggaagagc

SEQ ID NO: 49012 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccgcagcaaagtgaggaccattaccaccaggtcaaactctataaagcagggcaaagaccagcatttccccgtcttcatgaacgagacgtcggaagagc

SEQ ID NO: 49013 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccgcaaagtgaggaccattaccaccaggtcaaactctataaagcagggcaaagaccagcatttccccgtcttcatgaacgagacgtcggaagagc

SEQ ID NO: 49014 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacgcgtgaggaccattaccaccaggtcaaactctataaagcagggcaaagaccagcatttccccgtcttcatgaacgagacgtcggaagagc

SEQ ID NO: 49015 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcgcaggaccattaccaccaggtcaaactctataaagcagggcaaagaccagcatttccccgtcttcatgaacgagacgtcggaagagc

SEQ ID NO: 49016 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcgcaccattaccaccaggtcaaactctataaagcagggcaaagaccagcatttccccgtcttcatgaacgagacgtcggaagagc

SEQ ID NO: 49017 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccgcattaccaccaggtcaaactctataaagcagggcaaagaccagcatttccccgtcttcatgaacgagacgtcggaagagc

SEQ ID NO: 49018 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcgcaccaccaggtcaaactctataaagcagggcaaagaccagcatttccccgtcttcatgaacgagacgtcggaagagc

SEQ ID NO: 49019 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccgcaccaggtcaaactctataaagcagggcaaagaccagcatttccccgtcttcatgaacgagacgtcggaagagc

SEQ ID NO: 49020 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccgcaggtcaaactctataaagcagggcaaagaccagcatttccccgtcttcatgaacgagacgtcggaagagc

SEQ ID NO: 49021 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcgctcaaactctataaagcagggcaaagaccagcatttccccgtcttcatgaacgagacgtcggaagagc

SEQ ID NO: 49022 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacgcaactctataaagcagggcaaagaccagcatttccccgtcttcatgaacgagacgtcggaagagc

SEQ ID NO: 49023 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccgctctataaagcagggcaaagaccagcatttccccgtcttcatgaacgagacgtcggaagagc

SEQ ID NO: 49024 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcgcataaagcagggcaaagaccagcatttccccgtcttcatgaacgagacgtcggaagagc

SEQ ID NO: 49025 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacgcaagcagggcaaagaccagcatttccccgtcttcatgaacgagacgtcggaagagc

SEQ ID NO: 49026 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcgccagggcaaagaccagcatttccccgtcttcatgaacgagacgtcggaagagc

SEQ ID NO: 49027 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcgcggcaaagaccagcatttccccgtcttcatgaacgagacgtcggaagagc

SEQ ID NO: 49028 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccgcaaagaccagcatttccccgtcttcatgaacgagacgtcggaagagc

SEQ ID NO: 49029 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacgcgaccagcatttccccgtcttcatgaacgagacgtcggaagagc

SEQ ID NO: 49030 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccgccagcatttccccgtcttcatgaacgagacgtcggaagagc

SEQ ID NO: 49031 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcgccatttccccgtcttcatgaacgagacgtcggaagagc

SEQ ID NO: 49032 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcgcttccccgtcttcatgaacgagacgtcggaagagc

SEQ ID NO: 49033 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccgccccgtcttcatgaacgagacgtcggaagagc

SEQ ID NO: 49034 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccgcgtcttcatgaacgagacgtcggaagagc

SEQ ID NO: 49035 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccgcttcatgaacgagacgtcggaagagc

SEQ ID NO: 49036 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttccgcatgaacgagacgtcggaagagc

SEQ ID NO: 49037 - RNA, 299 nt, synthetic construct
  source 1..299: mol_type = other RNA
cgctcttccgcgtctcaagagggacccgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49038 - RNA, 299 nt, synthetic construct
  source 1..299: mol_type = other RNA
cgctcttccgcgtctcaagagggacatcccgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49039 - RNA, 299 nt, synthetic construct
  source 1..299: mol_type = other RNA
cgctcttccgcgtctcaagagggacatctcgccgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49040 - RNA, 299 nt, synthetic construct
  source 1..299: mol_type = other RNA
cgctcttccgcgtctcaagagggacatctcgcgaccgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49041 - RNA, 299 nt, synthetic construct
  source 1..299: mol_type = other RNA
cgctcttccgcgtctcaagagggacatctcgcgatttccgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49042 - RNA, 299 nt, synthetic construct
  source 1..299: mol_type = other RNA
cgctcttccgcgtctcaagagggacatctcgcgatttcttccggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49043 - RNA, 299 nt, synthetic construct
  source 1..299: mol_type = other RNA
cgctcttccgcgtctcaagagggacatctcgcgatttcttgagccgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49044 - RNA, 299 nt, synthetic construct
  source 1..299: mol_type = other RNA
cgctcttccgcgtctcaagagggacatctcgcgatttcttgagtctccgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49045 - RNA, 299 nt, synthetic construct
  source 1..299: mol_type = other RNA
cgctcttccgcgtctcaagagggacatctcgcgatttcttgagtctaacccgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49046 - RNA, 299 nt, synthetic construct
  source 1..299: mol_type = other RNA
cgctcttccgcgtctcaagagggacatctcgcgatttcttgagtctaaccccccggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49047 - RNA, 299 nt, synthetic construct
  source 1..299: mol_type = other RNA
cgctcttccgcgtctcaagagggacatctcgcgatttcttgagtctaaccccgtgccgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49048 - RNA, 299 nt, synthetic construct
  source 1..299: mol_type = other RNA
cgctcttccgcgtctcaagagggacatctcgcgatttcttgagtctaaccccgtgatgccgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49049 - RNA, 299 nt, synthetic construct
  source 1..299: mol_type = other RNA
cgctcttccgcgtctcaagagggacatctcgcgatttcttgagtctaaccccgtgatgattccggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49050 - RNA, 299 nt, synthetic construct
  source 1..299: mol_type = other RNA
cgctcttccgcgtctcaagagggacatctcgcgatttcttgagtctaaccccgtgatgattgacccggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49051 - RNA, 299 nt, synthetic construct
  source 1..299: mol_type = other RNA
cgctcttccgcgtctcaagagggacatctcgcgatttcttgagtctaaccccgtgatgattgacgccccgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49052 - RNA, 299 nt, synthetic construct
  source 1..299: mol_type = other RNA
cgctcttccgcgtctcaagagggacatctcgcgatttcttgagtctaaccccgtgatgattgacgccaaaccggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49053 - RNA, 299 nt, synthetic construct
  source 1..299: mol_type = other RNA
cgctcttccgcgtctcaagagggacatctcgcgatttcttgagtctaaccccgtgatgattgacgccaaagaaccggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49054 - RNA, 299 nt, synthetic construct
  source 1..299: mol_type = other RNA
cgctcttccgcgtctcaagagggacatctcgcgatttcttgagtctaaccccgtgatgattgacgccaaagaagtgccgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49055 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctccggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49056 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctccggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49057 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaccgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49058 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacccgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49059 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggccggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49060 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccccgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49061 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtccgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49062 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacccgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49063 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcccgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49064 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggccgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49065 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtccgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49066 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacccgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49067 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49068 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctccgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49069 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcccgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49070 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgccgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49071 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacccgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49072 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49073 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctccgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49074 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgccggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49075 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaccgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49076 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccccgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49077 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactccggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49078 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgccgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49079 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatccggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49080 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatccgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49081 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagccgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49082 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgccggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49083 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagccgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49084 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgccgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49085 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaccggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49086 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagccgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49087 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtccgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49088 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgccggagcacggcagaatagccaagttcagcaaagtgaggaccattaccaccaggtcaaactctataaagcagggcaaagaccagcatttccccgtcttcatgaacgagacgtcggaagagc

SEQ ID NO: 49089 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagccgcacggcagaatagccaagttcagcaaagtgaggaccattaccaccaggtcaaactctataaagcagggcaaagaccagcatttccccgtcttcatgaacgagacgtcggaagagc

SEQ ID NO: 49090 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacccgggcagaatagccaagttcagcaaagtgaggaccattaccaccaggtcaaactctataaagcagggcaaagaccagcatttccccgtcttcatgaacgagacgtcggaagagc

SEQ ID NO: 49091 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcccgagaatagccaagttcagcaaagtgaggaccattaccaccaggtcaaactctataaagcagggcaaagaccagcatttccccgtcttcatgaacgagacgtcggaagagc

SEQ ID NO: 49092 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaccgatagccaagttcagcaaagtgaggaccattaccaccaggtcaaactctataaagcagggcaaagaccagcatttccccgtcttcatgaacgagacgtcggaagagc

SEQ ID NO: 49093 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataccggccaagttcagcaaagtgaggaccattaccaccaggtcaaactctataaagcagggcaaagaccagcatttccccgtcttcatgaacgagacgtcggaagagc

SEQ ID NO: 49094 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccccgaagttcagcaaagtgaggaccattaccaccaggtcaaactctataaagcagggcaaagaccagcatttccccgtcttcatgaacgagacgtcggaagagc

SEQ ID NO: 49095 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagccgttcagcaaagtgaggaccattaccaccaggtcaaactctataaagcagggcaaagaccagcatttccccgtcttcatgaacgagacgtcggaagagc

SEQ ID NO: 49096 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcccgagcaaagtgaggaccattaccaccaggtcaaactctataaagcagggcaaagaccagcatttccccgtcttcatgaacgagacgtcggaagagc

SEQ ID NO: 49097 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcccgaaagtgaggaccattaccaccaggtcaaactctataaagcagggcaaagaccagcatttccccgtcttcatgaacgagacgtcggaagagc

SEQ ID NO: 49098 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaccggtgaggaccattaccaccaggtcaaactctataaagcagggcaaagaccagcatttccccgtcttcatgaacgagacgtcggaagagc

SEQ ID NO: 49099 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgccgaggaccattaccaccaggtcaaactctataaagcagggcaaagaccagcatttccccgtcttcatgaacgagacgtcggaagagc

SEQ ID NO: 49100 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggccgaccattaccaccaggtcaaactctataaagcagggcaaagaccagcatttccccgtcttcatgaacgagacgtcggaagagc

SEQ ID NO: 49101 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccccgattaccaccaggtcaaactctataaagcagggcaaagaccagcatttccccgtcttcatgaacgagacgtcggaagagc

SEQ ID NO: 49102 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattccgaccaccaggtcaaactctataaagcagggcaaagaccagcatttccccgtcttcatgaacgagacgtcggaagagc

SEQ ID NO: 49103 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccccgaccaggtcaaactctataaagcagggcaaagaccagcatttccccgtcttcatgaacgagacgtcggaagagc

SEQ ID NO: 49104 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccccgaggtcaaactctataaagcagggcaaagaccagcatttccccgtcttcatgaacgagacgtcggaagagc

SEQ ID NO: 49105 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggccgtcaaactctataaagcagggcaaagaccagcatttccccgtcttcatgaacgagacgtcggaagagc

SEQ ID NO: 49106 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaccgaactctataaagcagggcaaagaccagcatttccccgtcttcatgaacgagacgtcggaagagc

SEQ ID NO: 49107 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacccgtctataaagcagggcaaagaccagcatttccccgtcttcatgaacgagacgtcggaagagc

SEQ ID NO: 49108 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctccgataaagcagggcaaagaccagcatttccccgtcttcatgaacgagacgtcggaagagc

SEQ ID NO: 49109 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataccgaagcagggcaaagaccagcatttccccgtcttcatgaacgagacgtcggaagagc

SEQ ID NO: 49110 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagccgcagggcaaagaccagcatttccccgtcttcatgaacgagacgtcggaagagc

SEQ ID NO: 49111 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagccgggcaaagaccagcatttccccgtcttcatgaacgagacgtcggaagagc

SEQ ID NO: 49112 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcccgaaagaccagcatttccccgtcttcatgaacgagacgtcggaagagc

SEQ ID NO: 49113 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaccggaccagcatttccccgtcttcatgaacgagacgtcggaagagc

SEQ ID NO: 49114 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacccgcagcatttccccgtcttcatgaacgagacgtcggaagagc

SEQ ID NO: 49115 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagccgcatttccccgtcttcatgaacgagacgtcggaagagc

SEQ ID NO: 49116 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatccgttccccgtcttcatgaacgagacgtcggaagagc

SEQ ID NO: 49117 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccgcccgtcttcatgaacgagacgtcggaagagc

SEQ ID NO: 49118 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccccggtcttcatgaacgagacgtcggaagagc

SEQ ID NO: 49119 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcccgttcatgaacgagacgtcggaagagc

SEQ ID NO: 49120 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcccgatgaacgagacgtcggaagagc

SEQ ID NO: 49121 - RNA, 299 nt, synthetic construct
  source 1..299: mol_type = other RNA
cgctcttccgcgtctcaagagggaccccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49122 - RNA, 299 nt, synthetic construct
  source 1..299: mol_type = other RNA
cgctcttccgcgtctcaagagggacatcccctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49123 - RNA, 299 nt, synthetic construct
  source 1..299: mol_type = other RNA
cgctcttccgcgtctcaagagggacatctcgccccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49124 - RNA, 299 nt, synthetic construct
  source 1..299: mol_type = other RNA
cgctcttccgcgtctcaagagggacatctcgcgaccctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49125 - RNA, 299 nt, synthetic construct
  source 1..299: mol_type = other RNA
cgctcttccgcgtctcaagagggacatctcgcgatttccccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49126 - RNA, 299 nt, synthetic construct
  source 1..299: mol_type = other RNA
cgctcttccgcgtctcaagagggacatctcgcgatttcttcccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49127 - RNA, 299 nt, synthetic construct
  source 1..299: mol_type = other RNA
cgctcttccgcgtctcaagagggacatctcgcgatttcttgagccctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49128 - RNA, 299 nt, synthetic construct
  source 1..299: mol_type = other RNA
cgctcttccgcgtctcaagagggacatctcgcgatttcttgagtctcccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49129 - RNA, 299 nt, synthetic construct
  source 1..299: mol_type = other RNA
cgctcttccgcgtctcaagagggacatctcgcgatttcttgagtctaacccccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49130 - RNA, 299 nt, synthetic construct; identical to SEQ ID NO: 49129
  source 1..299: mol_type = other RNA

SEQ ID NO: 49131 - RNA, 299 nt, synthetic construct
  source 1..299: mol_type = other RNA
cgctcttccgcgtctcaagagggacatctcgcgatttcttgagtctaaccccgtgcccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49132 - RNA, 299 nt, synthetic construct
  source 1..299: mol_type = other RNA
cgctcttccgcgtctcaagagggacatctcgcgatttcttgagtctaaccccgtgatgcccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49133 - RNA, 299 nt, synthetic construct
  source 1..299: mol_type = other RNA
cgctcttccgcgtctcaagagggacatctcgcgatttcttgagtctaaccccgtgatgattcccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49134 - RNA, 299 nt, synthetic construct
  source 1..299: mol_type = other RNA
cgctcttccgcgtctcaagagggacatctcgcgatttcttgagtctaaccccgtgatgattgaccccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49135 - RNA, 299 nt, synthetic construct
  source 1..299: mol_type = other RNA
cgctcttccgcgtctcaagagggacatctcgcgatttcttgagtctaaccccgtgatgattgacgcccccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49136 - RNA, 299 nt, synthetic construct
  source 1..299: mol_type = other RNA
cgctcttccgcgtctcaagagggacatctcgcgatttcttgagtctaaccccgtgatgattgacgccaaacccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49137 - RNA, 299 nt, synthetic construct
  source 1..299: mol_type = other RNA
cgctcttccgcgtctcaagagggacatctcgcgatttcttgagtctaaccccgtgatgattgacgccaaagaacccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49138 - RNA, 299 nt, synthetic construct
  source 1..299: mol_type = other RNA
cgctcttccgcgtctcaagagggacatctcgcgatttcttgagtctaaccccgtgatgattgacgccaaagaagtgccctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49139 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctcccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49140 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctcccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49141 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaccccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49142 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacaccccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49143 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggcccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49144 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccccccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49145 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtccctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49146 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttaccccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49147 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcccctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49148 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggcccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49149 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtcccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49150 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacccccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49151 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttccccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49152 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49153 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49154 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49155 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49156 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49157 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49158 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49159 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaccctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49160 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49161 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49162 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49163 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49164 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49165 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49166 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49167 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49168 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgccccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49169 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49170 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagccctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49171 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49172 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcccgagcacggcagaatagccaagttcagcaaagtgaggaccattaccaccaggtcaaactctataaagcagggcaaagaccagcatttccccgtcttcatgaacgagacgtcggaagagc

SEQ ID NO: 49173 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagccccacggcagaatagccaagttcagcaaagtgaggaccattaccaccaggtcaaactctataaagcagggcaaagaccagcatttccccgtcttcatgaacgagacgtcggaagagc

SEQ ID NO: 49174 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccccggcagaatagccaagttcagcaaagtgaggaccattaccaccaggtcaaactctataaagcagggcaaagaccagcatttccccgtcttcatgaacgagacgtcggaagagc

SEQ ID NO: 49175 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccccagaatagccaagttcagcaaagtgaggaccattaccaccaggtcaaactctataaagcagggcaaagaccagcatttccccgtcttcatgaacgagacgtcggaagagc

SEQ ID NO: 49176 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacccatagccaagttcagcaaagtgaggaccattaccaccaggtcaaactctataaagcagggcaaagaccagcatttccccgtcttcatgaacgagacgtcggaagagc

SEQ ID NO: 49177 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacccgccaagttcagcaaagtgaggaccattaccaccaggtcaaactctataaagcagggcaaagaccagcatttccccgtcttcatgaacgagacgtcggaagagc

SEQ ID NO: 49178 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccccaagttcagcaaagtgaggaccattaccaccaggtcaaactctataaagcagggcaaagaccagcatttccccgtcttcatgaacgagacgtcggaagagc

SEQ ID NO: 49179 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcccttcagcaaagtgaggaccattaccaccaggtcaaactctataaagcagggcaaagaccagcatttccccgtcttcatgaacgagacgtcggaagagc

SEQ ID NO: 49180 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccccagcaaagtgaggaccattaccaccaggtcaaactctataaagcagggcaaagaccagcatttccccgtcttcatgaacgagacgtcggaagagc

SEQ ID NO: 49181 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccccaaagtgaggaccattaccaccaggtcaaactctataaagcagggcaaagaccagcatttccccgtcttcatgaacgagacgtcggaagagc

SEQ ID NO: 49182 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacccgtgaggaccattaccaccaggtcaaactctataaagcagggcaaagaccagcatttccccgtcttcatgaacgagacgtcggaagagc

SEQ ID NO: 49183 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcccaggaccattaccaccaggtcaaactctataaagcagggcaaagaccagcatttccccgtcttcatgaacgagacgtcggaagagc

SEQ ID NO: 49184 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcccaccattaccaccaggtcaaactctataaagcagggcaaagaccagcatttccccgtcttcatgaacgagacgtcggaagagc

SEQ ID NO: 49185 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccccattaccaccaggtcaaactctataaagcagggcaaagaccagcatttccccgtcttcatgaacgagacgtcggaagagc

SEQ ID NO: 49186 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcccaccaccaggtcaaactctataaagcagggcaaagaccagcatttccccgtcttcatgaacgagacgtcggaagagc

SEQ ID NO: 49187 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccccaccaggtcaaactctataaagcagggcaaagaccagcatttccccgtcttcatgaacgagacgtcggaagagc

SEQ ID NO: 49188 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccccaggtcaaactctataaagcagggcaaagaccagcatttccccgtcttcatgaacgagacgtcggaagagc

SEQ ID NO: 49189 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggccctcaaactctataaagcagggcaaagaccagcatttccccgtcttcatgaacgagacgtcggaagagc

SEQ ID NO: 49190 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacccaactctataaagcagggcaaagaccagcatttccccgtcttcatgaacgagacgtcggaagagc

SEQ ID NO: 49191 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacccctctataaagcagggcaaagaccagcatttccccgtcttcatgaacgagacgtcggaagagc

SEQ ID NO: 49192 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcccataaagcagggcaaagaccagcatttccccgtcttcatgaacgagacgtcggaagagc

SEQ ID NO: 49193 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacccaagcagggcaaagaccagcatttccccgtcttcatgaacgagacgtcggaagagc

SEQ ID NO: 49194 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagccccagggcaaagaccagcatttccccgtcttcatgaacgagacgtcggaagagc

SEQ ID NO: 49195 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcccggcaaagaccagcatttccccgtcttcatgaacgagacgtcggaagagc

SEQ ID NO: 49196 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccccaaagaccagcatttccccgtcttcatgaacgagacgtcggaagagc

SEQ ID NO: 49197 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacccgaccagcatttccccgtcttcatgaacgagacgtcggaagagc

SEQ ID NO: 49198 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacccccagcatttccccgtcttcatgaacgagacgtcggaagagc

SEQ ID NO: 49199 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagccccatttccccgtcttcatgaacgagacgtcggaagagc

SEQ ID NO: 49200 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcccttccccgtcttcatgaacgagacgtcggaagagc

SEQ ID NO: 49201 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccccgtcttcatgaacgagacgtcggaagagc

SEQ ID NO: 49202 - RNA, 299 nt, synthetic construct; identical to SEQ ID NO: 49201
  source 1..299: mol_type = other RNA

SEQ ID NO: 49203 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccccttcatgaacgagacgtcggaagagc

SEQ ID NO: 49204 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttccccatgaacgagacgtcggaagagc

SEQ ID NO: 49205 - RNA, 293 nt, synthetic construct
  source 1..293: mol_type = other RNA
cgctcttccgcgtctcaagaggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49206 - RNA, 293 nt, synthetic construct
  source 1..293: mol_type = other RNA
cgctcttccgcgtctcaagagggactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49207 - RNA, 293 nt, synthetic construct
  source 1..293: mol_type = other RNA
cgctcttccgcgtctcaagagggacatccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49208 - RNA, 293 nt, synthetic construct
  source 1..293: mol_type = other RNA
cgctcttccgcgtctcaagagggacatctcgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49209 - RNA, 293 nt, synthetic construct
  source 1..293: mol_type = other RNA
cgctcttccgcgtctcaagagggacatctcgcgacttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49210 - RNA, 293 nt, synthetic construct
  source 1..293: mol_type = other RNA
cgctcttccgcgtctcaagagggacatctcgcgatttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49211 - RNA, 293 nt, synthetic construct
  source 1..293: mol_type = other RNA
cgctcttccgcgtctcaagagggacatctcgcgatttctttctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49212 - RNA, 293 nt, synthetic construct
  source 1..293: mol_type = other RNA
cgctcttccgcgtctcaagagggacatctcgcgatttcttgagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49213 - RNA, 293 nt, synthetic construct
  source 1..293: mol_type = other RNA
cgctcttccgcgtctcaagagggacatctcgcgatttcttgagtctcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49214 - RNA, 293 nt, synthetic construct
  source 1..293: mol_type = other RNA
cgctcttccgcgtctcaagagggacatctcgcgatttcttgagtctaacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49215 - RNA, 293 nt, synthetic construct
  source 1..293: mol_type = other RNA
cgctcttccgcgtctcaagagggacatctcgcgatttcttgagtctaaccccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49216 - RNA, 293 nt, synthetic construct
  source 1..293: mol_type = other RNA
cgctcttccgcgtctcaagagggacatctcgcgatttcttgagtctaaccccgtgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49217 - RNA, 293 nt, synthetic construct
  source 1..293: mol_type = other RNA
cgctcttccgcgtctcaagagggacatctcgcgatttcttgagtctaaccccgtgatggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49218 - RNA, 293 nt, synthetic construct
  source 1..293: mol_type = other RNA
cgctcttccgcgtctcaagagggacatctcgcgatttcttgagtctaaccccgtgatgattgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49219 - RNA, 293 nt, synthetic construct
  source 1..293: mol_type = other RNA
cgctcttccgcgtctcaagagggacatctcgcgatttcttgagtctaaccccgtgatgattgacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49220 - RNA, 293 nt, synthetic construct
  source 1..293: mol_type = other RNA
cgctcttccgcgtctcaagagggacatctcgcgatttcttgagtctaaccccgtgatgattgacgccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49221 - RNA, 293 nt, synthetic construct
  source 1..293: mol_type = other RNA
cgctcttccgcgtctcaagagggacatctcgcgatttcttgagtctaaccccgtgatgattgacgccaaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49222 - RNA, 293 nt, synthetic construct
  source 1..293: mol_type = other RNA
cgctcttccgcgtctcaagagggacatctcgcgatttcttgagtctaaccccgtgatgattgacgccaaagaatctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49223 - RNA, 293 nt, synthetic construct
  source 1..293: mol_type = other RNA
cgctcttccgcgtctcaagagggacatctcgcgatttcttgagtctaaccccgtgatgattgacgccaaagaagtggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49224 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49225 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49226 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcaagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49227 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49228 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacaggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49229 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49230 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgtttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49231 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49232 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49233 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49234 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49235 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49236 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49237 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49238 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49239 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49240 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49241 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49242 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49243 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49244 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49245 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49246 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49247 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49248 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49249 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49250 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49251 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49252 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49253 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49254 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49255 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 49256 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgagcacggcagaatagccaagttcagcaaagtgaggaccattaccaccaggtcaaactctataaagcagggcaaagaccagcatttccccgtcttcatgaacgagacgtcggaagagc

SEQ ID NO: 49257 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcacggcagaatagccaagttcagcaaagtgaggaccattaccaccaggtcaaactctataaagcagggcaaagaccagcatttccccgtcttcatgaacgagacgtcggaagagc

SEQ ID NO: 49258 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagggcagaatagccaagttcagcaaagtgaggaccattaccaccaggtcaaactctataaagcagggcaaagaccagcatttccccgtcttcatgaacgagacgtcggaagagc

SEQ ID NO: 49259 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacagaatagccaagttcagcaaagtgaggaccattaccaccaggtcaaactctataaagcagggcaaagaccagcatttccccgtcttcatgaacgagacgtcggaagagc

SEQ ID NO: 49260 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcatagccaagttcagcaaagtgaggaccattaccaccaggtcaaactctataaagcagggcaaagaccagcatttccccgtcttcatgaacgagacgtcggaagagc

SEQ ID NO: 49261 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagccaagttcagcaaagtgaggaccattaccaccaggtcaaactctataaagcagggcaaagaccagcatttccccgtcttcatgaacgagacgtcggaagagc

SEQ ID NO: 49262 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaagttcagcaaagtgaggaccattaccaccaggtcaaactctataaagcagggcaaagaccagcatttccccgtcttcatgaacgagacgtcggaagagc

SEQ ID NO: 49263 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccttcagcaaagtgaggaccattaccaccaggtcaaactctataaagcagggcaaagaccagcatttccccgtcttcatgaacgagacgtcggaagagc

SEQ ID NO: 49264 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagagcaaagtgaggaccattaccaccaggtcaaactctataaagcagggcaaagaccagcatttccccgtcttcatgaacgagacgtcggaagagc

SEQ ID NO: 49265 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaaagtgaggaccattaccaccaggtcaaactctataaagcagggcaaagaccagcatttccccgtcttcatgaacgagacgtcggaagagc

SEQ ID NO: 49266 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgtgaggaccattaccaccaggtcaaactctataaagcagggcaaagaccagcatttccccgtcttcatgaacgagacgtcggaagagc

SEQ ID NO: 49267 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaggaccattaccaccaggtcaaactctataaagcagggcaaagaccagcatttccccgtcttcatgaacgagacgtcggaagagc

SEQ ID NO: 49268 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaccattaccaccaggtcaaactctataaagcagggcaaagaccagcatttccccgtcttcatgaacgagacgtcggaagagc

SEQ ID NO: 49269 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggattaccaccaggtcaaactctataaagcagggcaaagaccagcatttccccgtcttcatgaacgagacgtcggaagagc

SEQ ID NO: 49270 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaccaccaggtcaaactctataaagcagggcaaagaccagcatttccccgtcttcatgaacgagacgtcggaagagc

SEQ ID NO: 49271 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaggtcaaactctataaagcagggcaaagaccagcatttccccgtcttcatgaacgagacgtcggaagagc

SEQ ID NO: 49272 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctcaaactctataaagcagggcaaagaccagcatttccccgtcttcatgaacgagacgtcggaagagc

SEQ ID NO: 49273 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaactctataaagcagggcaaagaccagcatttccccgtcttcatgaacgagacgtcggaagagc

SEQ ID NO: 49274 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatctataaagcagggcaaagaccagcatttccccgtcttcatgaacgagacgtcggaagagc

SEQ ID NO: 49275 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacataaagcagggcaaagaccagcatttccccgtcttcatgaacgagacgtcggaagagc

SEQ ID NO: 49276 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaagcagggcaaagaccagcatttccccgtcttcatgaacgagacgtcggaagagc

SEQ ID NO: 49277 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacagggcaaagaccagcatttccccgtcttcatgaacgagacgtcggaagagc

SEQ ID NO: 49278 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagggcaaagaccagcatttccccgtcttcatgaacgagacgtcggaagagc

SEQ ID NO: 49279 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaaagaccagcatttccccgtcttcatgaacgagacgtcggaagagc

SEQ ID NO: 49280 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgaccagcatttccccgtcttcatgaacgagacgtcggaagagc

SEQ ID NO: 49281 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacagcatttccccgtcttcatgaacgagacgtcggaagagc

SEQ ID NO: 49282 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccatttccccgtcttcatgaacgagacgtcggaagagc

SEQ ID NO: 49283 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagttccccgtcttcatgaacgagacgtcggaagagc

SEQ ID NO: 49284 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcccgtcttcatgaacgagacgtcggaagagc

SEQ ID NO: 49285 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgtcttcatgaacgagacgtcggaagagc

SEQ ID NO: 49286 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccttcatgaacgagacgtcggaagagc

SEQ ID NO: 49287 - RNA, 293 nt, synthetic construct
  source 1..293: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcatgaacgagacgtcggaagagc

SEQ ID NO: 49288 - RNA, 296 nt, synthetic construct; identical to SEQ ID NO: 43873
  source 1..296: mol_type = other RNA

SEQ ID NO: 49289 - RNA, 293 nt, synthetic construct
  source 1..293: mol_type = other RNA
cgctcttccgcgtctcgtcttcaagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49290 - RNA, 293 nt, synthetic construct
  source 1..293: mol_type = other RNA
cgctcttccgcgtctcgtcttcatgaaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49291 - RNA, 293 nt, synthetic construct
  source 1..293: mol_type = other RNA
cgctcttccgcgtctcgtcttcatgaacaagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49292 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49293 - RNA, 293 nt, synthetic construct
  source 1..293: mol_type = other RNA
cgctcttccgcgtctcgtcttcatgaacgagaagaaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49294 - RNA, 293 nt, synthetic construct
  source 1..293: mol_type = other RNA
cgctcttccgcgtctcgtcttcatgaacgagaaggagaagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49295 - RNA, 293 nt, synthetic construct
  source 1..293: mol_type = other RNA
cgctcttccgcgtctcgtcttcatgaacgagaaggaggacaagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49296 - RNA, 293 nt, synthetic construct
  source 1..293: mol_type = other RNA
cgctcttccgcgtctcgtcttcatgaacgagaaggaggacatcaagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49297 - RNA, 293 nt, synthetic construct
  source 1..293: mol_type = other RNA
cgctcttccgcgtctcgtcttcatgaacgagaaggaggacatcctgaagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49298 - RNA, 293 nt, synthetic construct
  source 1..293: mol_type = other RNA
cgctcttccgcgtctcgtcttcatgaacgagaaggaggacatcctgtggaagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49299 - RNA, 293 nt, synthetic construct
  source 1..293: mol_type = other RNA
cgctcttccgcgtctcgtcttcatgaacgagaaggaggacatcctgtggtgcaaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49300 - RNA, 293 nt, synthetic construct
  source 1..293: mol_type = other RNA
cgctcttccgcgtctcgtcttcatgaacgagaaggaggacatcctgtggtgcactaagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49301 - RNA, 293 nt, synthetic construct
  source 1..293: mol_type = other RNA
cgctcttccgcgtctcgtcttcatgaacgagaaggaggacatcctgtggtgcactgaaaaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49302 - RNA, 293 nt, synthetic construct
  source 1..293: mol_type = other RNA
cgctcttccgcgtctcgtcttcatgaacgagaaggaggacatcctgtggtgcactgaaatgaagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49303 - RNA, 293 nt, synthetic construct
  source 1..293: mol_type = other RNA
cgctcttccgcgtctcgtcttcatgaacgagaaggaggacatcctgtggtgcactgaaatggaaaaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49304 - RNA, 293 nt, synthetic construct
  source 1..293: mol_type = other RNA
cgctcttccgcgtctcgtcttcatgaacgagaaggaggacatcctgtggtgcactgaaatggaaaggaagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49305 - RNA, 293 nt, synthetic construct
  source 1..293: mol_type = other RNA
cgctcttccgcgtctcgtcttcatgaacgagaaggaggacatcctgtggtgcactgaaatggaaagggtgaagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49306 - RNA, 293 nt, synthetic construct
  source 1..293: mol_type = other RNA
cgctcttccgcgtctcgtcttcatgaacgagaaggaggacatcctgtggtgcactgaaatggaaagggtgtttaagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49307 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcaagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49308 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcaaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49309 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccaagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49310 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcaagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49311 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacaagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49312 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacaaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49313 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaaaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49314 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacaagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49315 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgaagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49316 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49317 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacaagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49318 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgaagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49319 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcaagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49320 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49321 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49322 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49323 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49324 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49325 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49326 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49327 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49328 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcaagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49329 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggaagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49330 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49331 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49332 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49333 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49334 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49335 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49336 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcaagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49337 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49338 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49339 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49340 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49341 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaagctgaaggaatattttgcttgtgtgtctagcggcaatagtaacgctaacagccgcgggccgagcttcagcagcggcctggtgccgttaagcttgcgcgagacgtcggaagagc

SEQ ID NO: 49342 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaagaaggaatattttgcttgtgtgtctagcggcaatagtaacgctaacagccgcgggccgagcttcagcagcggcctggtgccgttaagcttgcgcgagacgtcggaagagc

SEQ ID NO: 49343 - RNA, 293 nt, synthetic construct; identical to SEQ ID NO: 49292
  source 1..293: mol_type = other RNA

SEQ ID NO: 49344 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagaagtattttgcttgtgtgtctagcggcaatagtaacgctaacagccgcgggccgagcttcagcagcggcctggtgccgttaagcttgcgcgagacgtcggaagagc

SEQ ID NO: 49345 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaaagtttgcttgtgtgtctagcggcaatagtaacgctaacagccgcgggccgagcttcagcagcggcctggtgccgttaagcttgcgcgagacgtcggaagagc

SEQ ID NO: 49346 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatataaggcttgtgtgtctagcggcaatagtaacgctaacagccgcgggccgagcttcagcagcggcctggtgccgttaagcttgcgcgagacgtcggaagagc

SEQ ID NO: 49347 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttaagtgtgtgtctagcggcaatagtaacgctaacagccgcgggccgagcttcagcagcggcctggtgccgttaagcttgcgcgagacgtcggaagagc

SEQ ID NO: 49348 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctaaggtgtctagcggcaatagtaacgctaacagccgcgggccgagcttcagcagcggcctggtgccgttaagcttgcgcgagacgtcggaagagc

SEQ ID NO: 49349 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtaagtctagcggcaatagtaacgctaacagccgcgggccgagcttcagcagcggcctggtgccgttaagcttgcgcgagacgtcggaagagc

SEQ ID NO: 49350 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaagagcggcaatagtaacgctaacagccgcgggccgagcttcagcagcggcctggtgccgttaagcttgcgcgagacgtcggaagagc

SEQ ID NO: 49351 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaagggcaatagtaacgctaacagccgcgggccgagcttcagcagcggcctggtgccgttaagcttgcgcgagacgtcggaagagc

SEQ ID NO: 49352 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaagaatagtaacgctaacagccgcgggccgagcttcagcagcggcctggtgccgttaagcttgcgcgagacgtcggaagagc

SEQ ID NO: 49353 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaagagtaacgctaacagccgcgggccgagcttcagcagcggcctggtgccgttaagcttgcgcgagacgtcggaagagc

SEQ ID NO: 49354 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataagaacgctaacagccgcgggccgagcttcagcagcggcctggtgccgttaagcttgcgcgagacgtcggaagagc

SEQ ID NO: 49355 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaggctaacagccgcgggccgagcttcagcagcggcctggtgccgttaagcttgcgcgagacgtcggaagagc

SEQ ID NO: 49356 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaagaacagccgcgggccgagcttcagcagcggcctggtgccgttaagcttgcgcgagacgtcggaagagc

SEQ ID NO: 49357 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaagagccgcgggccgagcttcagcagcggcctggtgccgttaagcttgcgcgagacgtcggaagagc

SEQ ID NO: 49358 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaagcgcgggccgagcttcagcagcggcctggtgccgttaagcttgcgcgagacgtcggaagagc

SEQ ID NO: 49359 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcaaggggccgagcttcagcagcggcctggtgccgttaagcttgcgcgagacgtcggaagagc

SEQ ID NO: 49360 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaagccgagcttcagcagcggcctggtgccgttaagcttgcgcgagacgtcggaagagc

SEQ ID NO: 49361 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaagagcttcagcagcggcctggtgccgttaagcttgcgcgagacgtcggaagagc

SEQ ID NO: 49362 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaagttcagcagcggcctggtgccgttaagcttgcgcgagacgtcggaagagc

SEQ ID NO: 49363 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaagagcagcggcctggtgccgttaagcttgcgcgagacgtcggaagagc

SEQ ID NO: 49364 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaagagcggcctggtgccgttaagcttgcgcgagacgtcggaagagc

SEQ ID NO: 49365 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaagggcctggtgccgttaagcttgcgcgagacgtcggaagagc

SEQ ID NO: 49366 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaagctggtgccgttaagcttgcgcgagacgtcggaagagc

SEQ ID NO: 49367 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaaggtgccgttaagcttgcgcgagacgtcggaagagc

SEQ ID NO: 49368 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaagccgttaagcttgcgcgagacgtcggaagagc

SEQ ID NO: 49369 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaagttaagcttgcgcgagacgtcggaagagc

SEQ ID NO: 49370 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaagagcttgcgcgagacgtcggaagagc

SEQ ID NO: 49371 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaagttgcgcgagacgtcggaagagc

SEQ ID NO: 49372 - RNA, 293 nt, synthetic construct
  source 1..293: mol_type = other RNA
cgctcttccgcgtctcgtcttcaacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49373 - RNA, 293 nt, synthetic construct; identical to SEQ ID NO: 49292
  source 1..293: mol_type = other RNA

SEQ ID NO: 49374 - RNA, 293 nt, synthetic construct
  source 1..293: mol_type = other RNA
cgctcttccgcgtctcgtcttcatgaacaacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49375 - RNA, 293 nt, synthetic construct
  source 1..293: mol_type = other RNA
cgctcttccgcgtctcgtcttcatgaacgagaacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49376 - RNA, 293 nt, synthetic construct
  source 1..293: mol_type = other RNA
cgctcttccgcgtctcgtcttcatgaacgagaagaacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49377 - RNA, 293 nt, synthetic construct
  source 1..293: mol_type = other RNA
cgctcttccgcgtctcgtcttcatgaacgagaaggagaacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49378 - RNA, 293 nt, synthetic construct
  source 1..293: mol_type = other RNA
cgctcttccgcgtctcgtcttcatgaacgagaaggaggacaacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49379 - RNA, 293 nt, synthetic construct
  source 1..293: mol_type = other RNA
cgctcttccgcgtctcgtcttcatgaacgagaaggaggacatcaactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49380 - RNA, 293 nt, synthetic construct
  source 1..293: mol_type = other RNA
cgctcttccgcgtctcgtcttcatgaacgagaaggaggacatcctgaactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49381 - RNA, 293 nt, synthetic construct
  source 1..293: mol_type = other RNA
cgctcttccgcgtctcgtcttcatgaacgagaaggaggacatcctgtggaacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49382 - RNA, 293 nt, synthetic construct
  source 1..293: mol_type = other RNA
cgctcttccgcgtctcgtcttcatgaacgagaaggaggacatcctgtggtgcaacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49383 - RNA, 293 nt, synthetic construct
  source 1..293: mol_type = other RNA
cgctcttccgcgtctcgtcttcatgaacgagaaggaggacatcctgtggtgcactaacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49384 - RNA, 293 nt, synthetic construct
  source 1..293: mol_type = other RNA
cgctcttccgcgtctcgtcttcatgaacgagaaggaggacatcctgtggtgcactgaaaacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49385 - RNA, 293 nt, synthetic construct
  source 1..293: mol_type = other RNA
cgctcttccgcgtctcgtcttcatgaacgagaaggaggacatcctgtggtgcactgaaatgaacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49386 - RNA, 293 nt, synthetic construct
  source 1..293: mol_type = other RNA
cgctcttccgcgtctcgtcttcatgaacgagaaggaggacatcctgtggtgcactgaaatggaaaacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49387 - RNA, 293 nt, synthetic construct
  source 1..293: mol_type = other RNA
cgctcttccgcgtctcgtcttcatgaacgagaaggaggacatcctgtggtgcactgaaatggaaaggaactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49388 - RNA, 293 nt, synthetic construct
  source 1..293: mol_type = other RNA
cgctcttccgcgtctcgtcttcatgaacgagaaggaggacatcctgtggtgcactgaaatggaaagggtgaacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49389 - RNA, 293 nt, synthetic construct
  source 1..293: mol_type = other RNA
cgctcttccgcgtctcgtcttcatgaacgagaaggaggacatcctgtggtgcactgaaatggaaagggtgtttaacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49390 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcaaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49391 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcaacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49392 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccaaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49393 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcaactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49394 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacaacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49395 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacaacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49396 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaaacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49397 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacaactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49398 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgaacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49399 - RNA, 293 nt, synthetic construct; identical to SEQ ID NO: 49292
  source 1..293: mol_type = other RNA

SEQ ID NO: 49400 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacaacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49401 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgaaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49402 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcaacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49403 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49404 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49405 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49406 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49407 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49408 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49409 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49410 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49411 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcaactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49412 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggaactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49413 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49414 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49415 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49416 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49417 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49418 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49419 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcaaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49420 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49421 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49422 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49423 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49424 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaacctgaaggaatattttgcttgtgtgtctagcggcaatagtaacgctaacagccgcgggccgagcttcagcagcggcctggtgccgttaagcttgcgcgagacgtcggaagagc

SEQ ID NO: 49425 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaacaaggaatattttgcttgtgtgtctagcggcaatagtaacgctaacagccgcgggccgagcttcagcagcggcctggtgccgttaagcttgcgcgagacgtcggaagagc

SEQ ID NO: 49426 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaacgaatattttgcttgtgtgtctagcggcaatagtaacgctaacagccgcgggccgagcttcagcagcggcctggtgccgttaagcttgcgcgagacgtcggaagagc

SEQ ID NO: 49427 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagaactattttgcttgtgtgtctagcggcaatagtaacgctaacagccgcgggccgagcttcagcagcggcctggtgccgttaagcttgcgcgagacgtcggaagagc

SEQ ID NO: 49428 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaaactttgcttgtgtgtctagcggcaatagtaacgctaacagccgcgggccgagcttcagcagcggcctggtgccgttaagcttgcgcgagacgtcggaagagc

SEQ ID NO: 49429 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatataacgcttgtgtgtctagcggcaatagtaacgctaacagccgcgggccgagcttcagcagcggcctggtgccgttaagcttgcgcgagacgtcggaagagc

SEQ ID NO: 49430 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttaactgtgtgtctagcggcaatagtaacgctaacagccgcgggccgagcttcagcagcggcctggtgccgttaagcttgcgcgagacgtcggaagagc

SEQ ID NO: 49431 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctaacgtgtctagcggcaatagtaacgctaacagccgcgggccgagcttcagcagcggcctggtgccgttaagcttgcgcgagacgtcggaagagc

SEQ ID NO: 49432 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtaactctagcggcaatagtaacgctaacagccgcgggccgagcttcagcagcggcctggtgccgttaagcttgcgcgagacgtcggaagagc

SEQ ID NO: 49433 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaacagcggcaatagtaacgctaacagccgcgggccgagcttcagcagcggcctggtgccgttaagcttgcgcgagacgtcggaagagc

SEQ ID NO: 49434 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaacggcaatagtaacgctaacagccgcgggccgagcttcagcagcggcctggtgccgttaagcttgcgcgagacgtcggaagagc

SEQ ID NO: 49435 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaacaatagtaacgctaacagccgcgggccgagcttcagcagcggcctggtgccgttaagcttgcgcgagacgtcggaagagc

SEQ ID NO: 49436 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaacagtaacgctaacagccgcgggccgagcttcagcagcggcctggtgccgttaagcttgcgcgagacgtcggaagagc

SEQ ID NO: 49437 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataacaacgctaacagccgcgggccgagcttcagcagcggcctggtgccgttaagcttgcgcgagacgtcggaagagc

SEQ ID NO: 49438 - RNA, 293 nt, synthetic construct; identical to SEQ ID NO: 49292
  source 1..293: mol_type = other RNA

SEQ ID NO: 49439 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaacaacagccgcgggccgagcttcagcagcggcctggtgccgttaagcttgcgcgagacgtcggaagagc

SEQ ID NO: 49440 - RNA, 293 nt, synthetic construct; identical to SEQ ID NO: 49292
  source 1..293: mol_type = other RNA

SEQ ID NO: 49441 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaaccgcgggccgagcttcagcagcggcctggtgccgttaagcttgcgcgagacgtcggaagagc

SEQ ID NO: 49442 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcaacgggccgagcttcagcagcggcctggtgccgttaagcttgcgcgagacgtcggaagagc

SEQ ID NO: 49443 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaacccgagcttcagcagcggcctggtgccgttaagcttgcgcgagacgtcggaagagc

SEQ ID NO: 49444 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaacagcttcagcagcggcctggtgccgttaagcttgcgcgagacgtcggaagagc

SEQ ID NO: 49445 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaacttcagcagcggcctggtgccgttaagcttgcgcgagacgtcggaagagc

SEQ ID NO: 49446 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaacagcagcggcctggtgccgttaagcttgcgcgagacgtcggaagagc

SEQ ID NO: 49447 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaacagcggcctggtgccgttaagcttgcgcgagacgtcggaagagc

SEQ ID NO: 49448 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaacggcctggtgccgttaagcttgcgcgagacgtcggaagagc

SEQ ID NO: 49449 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaacctggtgccgttaagcttgcgcgagacgtcggaagagc

SEQ ID NO: 49450 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaacgtgccgttaagcttgcgcgagacgtcggaagagc

SEQ ID NO: 49451 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaacccgttaagcttgcgcgagacgtcggaagagc

SEQ ID NO: 49452 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaacttaagcttgcgcgagacgtcggaagagc

SEQ ID NO: 49453 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaacagcttgcgcgagacgtcggaagagc

SEQ ID NO: 49454 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaacttgcgcgagacgtcggaagagc

SEQ ID NO: 49455 - RNA, 293 nt, synthetic construct; identical to SEQ ID NO: 49292
  source 1..293: mol_type = other RNA

SEQ ID NO: 49456 - RNA, 293 nt, synthetic construct
  source 1..293: mol_type = other RNA
cgctcttccgcgtctcgtcttcatgatggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49457 - RNA, 293 nt, synthetic construct
  source 1..293: mol_type = other RNA
cgctcttccgcgtctcgtcttcatgaacatgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49458 - RNA, 293 nt, synthetic construct
  source 1..293: mol_type = other RNA
cgctcttccgcgtctcgtcttcatgaacgagatggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49459 - RNA, 293 nt, synthetic construct
  source 1..293: mol_type = other RNA
cgctcttccgcgtctcgtcttcatgaacgagaagatggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49460 - RNA, 293 nt, synthetic construct
  source 1..293: mol_type = other RNA
cgctcttccgcgtctcgtcttcatgaacgagaaggagatgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49461 - RNA, 293 nt, synthetic construct
  source 1..293: mol_type = other RNA
cgctcttccgcgtctcgtcttcatgaacgagaaggaggacatgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49462 - RNA, 293 nt, synthetic construct
  source 1..293: mol_type = other RNA
cgctcttccgcgtctcgtcttcatgaacgagaaggaggacatcatgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49463 - RNA, 293 nt, synthetic construct
  source 1..293: mol_type = other RNA
cgctcttccgcgtctcgtcttcatgaacgagaaggaggacatcctgatgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49464 - RNA, 293 nt, synthetic construct
  source 1..293: mol_type = other RNA
cgctcttccgcgtctcgtcttcatgaacgagaaggaggacatcctgtggatgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49465 - RNA, 293 nt, synthetic construct
  source 1..293: mol_type = other RNA
cgctcttccgcgtctcgtcttcatgaacgagaaggaggacatcctgtggtgcatggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49466 - RNA, 293 nt, synthetic construct
  source 1..293: mol_type = other RNA
cgctcttccgcgtctcgtcttcatgaacgagaaggaggacatcctgtggtgcactatgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49467 - RNA, 293 nt, synthetic construct; identical to SEQ ID NO: 49292
  source 1..293: mol_type = other RNA

SEQ ID NO: 49468 - RNA, 293 nt, synthetic construct
  source 1..293: mol_type = other RNA
cgctcttccgcgtctcgtcttcatgaacgagaaggaggacatcctgtggtgcactgaaatgatgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49469 - RNA, 293 nt, synthetic construct
  source 1..293: mol_type = other RNA
cgctcttccgcgtctcgtcttcatgaacgagaaggaggacatcctgtggtgcactgaaatggaaatggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49470 - RNA, 293 nt, synthetic construct
  source 1..293: mol_type = other RNA
cgctcttccgcgtctcgtcttcatgaacgagaaggaggacatcctgtggtgcactgaaatggaaaggatgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49471 - RNA, 293 nt, synthetic construct
  source 1..293: mol_type = other RNA
cgctcttccgcgtctcgtcttcatgaacgagaaggaggacatcctgtggtgcactgaaatggaaagggtgatgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49472 - RNA, 293 nt, synthetic construct
  source 1..293: mol_type = other RNA
cgctcttccgcgtctcgtcttcatgaacgagaaggaggacatcctgtggtgcactgaaatggaaagggtgtttatgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49473 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcatgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49474 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcatggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49475 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccatgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49476 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcatgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49477 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacatgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49478 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacatggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49479 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaatggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49480 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacatgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49481 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgatgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49482 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccatgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49483 - RNA, 293 nt, synthetic construct; identical to SEQ ID NO: 49292
  source 1..293: mol_type = other RNA

SEQ ID NO: 49484 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgatgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49485 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcatgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49486 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcatggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49487 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgatgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49488 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgatgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49489 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggatgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49490 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagatgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49491 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaatgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49492 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgatgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49493 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgatgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49494 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcatgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49495 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggatgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49496 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgatgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49497 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggatggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49498 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcatgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49499 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgatggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49500 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgatgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49501 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49502 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcatgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49503 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcatgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49504 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacatgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49505 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcatggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49506 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcatgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49507 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctatgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49508 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgatgaaggaatattttgcttgtgtgtctagcggcaatagtaacgctaacagccgcgggccgagcttcagcagcggcctggtgccgttaagcttgcgcgagacgtcggaagagc

SEQ ID NO: 49509 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgatggaatattttgcttgtgtgtctagcggcaatagtaacgctaacagccgcgggccgagcttcagcagcggcctggtgccgttaagcttgcgcgagacgtcggaagagc

SEQ ID NO: 49510 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagatgtattttgcttgtgtgtctagcggcaatagtaacgctaacagccgcgggccgagcttcagcagcggcctggtgccgttaagcttgcgcgagacgtcggaagagc

SEQ ID NO: 49511 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaatgtttgcttgtgtgtctagcggcaatagtaacgctaacagccgcgggccgagcttcagcagcggcctggtgccgttaagcttgcgcgagacgtcggaagagc

SEQ ID NO: 49512 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatatggcttgtgtgtctagcggcaatagtaacgctaacagccgcgggccgagcttcagcagcggcctggtgccgttaagcttgcgcgagacgtcggaagagc

SEQ ID NO: 49513 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttatgtgtgtgtctagcggcaatagtaacgctaacagccgcgggccgagcttcagcagcggcctggtgccgttaagcttgcgcgagacgtcggaagagc

SEQ ID NO: 49514 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctatggtgtctagcggcaatagtaacgctaacagccgcgggccgagcttcagcagcggcctggtgccgttaagcttgcgcgagacgtcggaagagc

SEQ ID NO: 49515 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtatgtctagcggcaatagtaacgctaacagccgcgggccgagcttcagcagcggcctggtgccgttaagcttgcgcgagacgtcggaagagc

SEQ ID NO: 49516 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgatgagcggcaatagtaacgctaacagccgcgggccgagcttcagcagcggcctggtgccgttaagcttgcgcgagacgtcggaagagc

SEQ ID NO: 49517 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctatgggcaatagtaacgctaacagccgcgggccgagcttcagcagcggcctggtgccgttaagcttgcgcgagacgtcggaagagc

SEQ ID NO: 49518 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcatgaatagtaacgctaacagccgcgggccgagcttcagcagcggcctggtgccgttaagcttgcgcgagacgtcggaagagc

SEQ ID NO: 49519 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcatgagtaacgctaacagccgcgggccgagcttcagcagcggcctggtgccgttaagcttgcgcgagacgtcggaagagc

SEQ ID NO: 49520 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatatgaacgctaacagccgcgggccgagcttcagcagcggcctggtgccgttaagcttgcgcgagacgtcggaagagc

SEQ ID NO: 49521 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtatggctaacagccgcgggccgagcttcagcagcggcctggtgccgttaagcttgcgcgagacgtcggaagagc

SEQ ID NO: 49522 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacatgaacagccgcgggccgagcttcagcagcggcctggtgccgttaagcttgcgcgagacgtcggaagagc

SEQ ID NO: 49523 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctatgagccgcgggccgagcttcagcagcggcctggtgccgttaagcttgcgcgagacgtcggaagagc

SEQ ID NO: 49524 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacatgcgcgggccgagcttcagcagcggcctggtgccgttaagcttgcgcgagacgtcggaagagc

SEQ ID NO: 49525 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcatggggccgagcttcagcagcggcctggtgccgttaagcttgcgcgagacgtcggaagagc

SEQ ID NO: 49526 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcatgccgagcttcagcagcggcctggtgccgttaagcttgcgcgagacgtcggaagagc

SEQ ID NO: 49527 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggatgagcttcagcagcggcctggtgccgttaagcttgcgcgagacgtcggaagagc

SEQ ID NO: 49528 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgatgttcagcagcggcctggtgccgttaagcttgcgcgagacgtcggaagagc

SEQ ID NO: 49529 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcatgagcagcggcctggtgccgttaagcttgcgcgagacgtcggaagagc

SEQ ID NO: 49530 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcatgagcggcctggtgccgttaagcttgcgcgagacgtcggaagagc

SEQ ID NO: 49531 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcatgggcctggtgccgttaagcttgcgcgagacgtcggaagagc

SEQ ID NO: 49532 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcatgctggtgccgttaagcttgcgcgagacgtcggaagagc

SEQ ID NO: 49533 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcatggtgccgttaagcttgcgcgagacgtcggaagagc

SEQ ID NO: 49534 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgatgccgttaagcttgcgcgagacgtcggaagagc

SEQ ID NO: 49535 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgatgttaagcttgcgcgagacgtcggaagagc

SEQ ID NO: 49536 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgatgagcttgcgcgagacgtcggaagagc

SEQ ID NO: 49537 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaatgttgcgcgagacgtcggaagagc

SEQ ID NO: 49538 - RNA, 293 nt, synthetic construct
  source 1..293: mol_type = other RNA
cgctcttccgcgtctcgtcttcatcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49539 - RNA, 293 nt, synthetic construct
  source 1..293: mol_type = other RNA
cgctcttccgcgtctcgtcttcatgatcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49540 - RNA, 293 nt, synthetic construct
  source 1..293: mol_type = other RNA
cgctcttccgcgtctcgtcttcatgaacatcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49541 - RNA, 293 nt, synthetic construct
  source 1..293: mol_type = other RNA
cgctcttccgcgtctcgtcttcatgaacgagatcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49542 - RNA, 293 nt, synthetic construct
  source 1..293: mol_type = other RNA
cgctcttccgcgtctcgtcttcatgaacgagaagatcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49543 - RNA, 293 nt, synthetic construct
  source 1..293: mol_type = other RNA
cgctcttccgcgtctcgtcttcatgaacgagaaggagatcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49544 - RNA, 293 nt, synthetic construct; identical to SEQ ID NO: 49292
  source 1..293: mol_type = other RNA

SEQ ID NO: 49545 - RNA, 293 nt, synthetic construct
  source 1..293: mol_type = other RNA
cgctcttccgcgtctcgtcttcatgaacgagaaggaggacatcatctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49546 - RNA, 293 nt, synthetic construct
  source 1..293: mol_type = other RNA
cgctcttccgcgtctcgtcttcatgaacgagaaggaggacatcctgatctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49547 - RNA, 293 nt, synthetic construct
  source 1..293: mol_type = other RNA
cgctcttccgcgtctcgtcttcatgaacgagaaggaggacatcctgtggatcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49548 - RNA, 293 nt, synthetic construct
  source 1..293: mol_type = other RNA
cgctcttccgcgtctcgtcttcatgaacgagaaggaggacatcctgtggtgcatcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49549 - RNA, 293 nt, synthetic construct
  source 1..293: mol_type = other RNA
cgctcttccgcgtctcgtcttcatgaacgagaaggaggacatcctgtggtgcactatcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49550 - RNA, 293 nt, synthetic construct
  source 1..293: mol_type = other RNA
cgctcttccgcgtctcgtcttcatgaacgagaaggaggacatcctgtggtgcactgaaatcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49551 - RNA, 293 nt, synthetic construct
  source 1..293: mol_type = other RNA
cgctcttccgcgtctcgtcttcatgaacgagaaggaggacatcctgtggtgcactgaaatgatcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49552 - RNA, 293 nt, synthetic construct
  source 1..293: mol_type = other RNA
cgctcttccgcgtctcgtcttcatgaacgagaaggaggacatcctgtggtgcactgaaatggaaatcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49553 - RNA, 293 nt, synthetic construct
  source 1..293: mol_type = other RNA
cgctcttccgcgtctcgtcttcatgaacgagaaggaggacatcctgtggtgcactgaaatggaaaggatctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49554 - RNA, 293 nt, synthetic construct
  source 1..293: mol_type = other RNA
cgctcttccgcgtctcgtcttcatgaacgagaaggaggacatcctgtggtgcactgaaatggaaagggtgatcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49555 - RNA, 293 nt, synthetic construct
  source 1..293: mol_type = other RNA
cgctcttccgcgtctcgtcttcatgaacgagaaggaggacatcctgtggtgcactgaaatggaaagggtgtttatcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49556 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcatccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49557 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcatcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49558 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccatccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49559 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcatctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49560 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacatcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49561 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacatcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49562 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaatcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49563 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacatctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49564 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgatcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49565 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccatcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49566 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49567 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgatccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49568 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcatcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49569 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcatcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49570 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgatcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49571 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgatccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49572 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggatcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49573 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagatcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49574 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaatcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49575 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgatcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49576 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgatccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49577 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcatctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49578 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggatctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49579 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgatcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49580 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggatcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49581 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcatcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49582 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgatcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49583 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgatcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49584 - RNA, 293 nt, synthetic construct; identical to SEQ ID NO: 49292
  source 1..293: mol_type = other RNA

SEQ ID NO: 49585 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcatccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49586 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcatcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49587 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacatcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49588 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcatcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49589 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcatcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49590 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctatcctgaaggaatattttgcttgtgtgtctagcggcaatagtaacgctaacagccgcgggccgagcttcagcagcggcctggtgccgttaagcttgcgcgagacgtcggaagagc

SEQ ID NO: 49591 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgatcaaggaatattttgcttgtgtgtctagcggcaatagtaacgctaacagccgcgggccgagcttcagcagcggcctggtgccgttaagcttgcgcgagacgtcggaagagc

SEQ ID NO: 49592 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgatcgaatattttgcttgtgtgtctagcggcaatagtaacgctaacagccgcgggccgagcttcagcagcggcctggtgccgttaagcttgcgcgagacgtcggaagagc

SEQ ID NO: 49593 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagatctattttgcttgtgtgtctagcggcaatagtaacgctaacagccgcgggccgagcttcagcagcggcctggtgccgttaagcttgcgcgagacgtcggaagagc

SEQ ID NO: 49594 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaatctttgcttgtgtgtctagcggcaatagtaacgctaacagccgcgggccgagcttcagcagcggcctggtgccgttaagcttgcgcgagacgtcggaagagc

SEQ ID NO: 49595 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatatcgcttgtgtgtctagcggcaatagtaacgctaacagccgcgggccgagcttcagcagcggcctggtgccgttaagcttgcgcgagacgtcggaagagc

SEQ ID NO: 49596 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttatctgtgtgtctagcggcaatagtaacgctaacagccgcgggccgagcttcagcagcggcctggtgccgttaagcttgcgcgagacgtcggaagagc

SEQ ID NO: 49597 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctatcgtgtctagcggcaatagtaacgctaacagccgcgggccgagcttcagcagcggcctggtgccgttaagcttgcgcgagacgtcggaagagc

SEQ ID NO: 49598 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtatctctagcggcaatagtaacgctaacagccgcgggccgagcttcagcagcggcctggtgccgttaagcttgcgcgagacgtcggaagagc

SEQ ID NO: 49599 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgatcagcggcaatagtaacgctaacagccgcgggccgagcttcagcagcggcctggtgccgttaagcttgcgcgagacgtcggaagagc

SEQ ID NO: 49600 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctatcggcaatagtaacgctaacagccgcgggccgagcttcagcagcggcctggtgccgttaagcttgcgcgagacgtcggaagagc

SEQ ID NO: 49601 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcatcaatagtaacgctaacagccgcgggccgagcttcagcagcggcctggtgccgttaagcttgcgcgagacgtcggaagagc

SEQ ID NO: 49602 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcatcagtaacgctaacagccgcgggccgagcttcagcagcggcctggtgccgttaagcttgcgcgagacgtcggaagagc

SEQ ID NO: 49603 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatatcaacgctaacagccgcgggccgagcttcagcagcggcctggtgccgttaagcttgcgcgagacgtcggaagagc

SEQ ID NO: 49604 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtatcgctaacagccgcgggccgagcttcagcagcggcctggtgccgttaagcttgcgcgagacgtcggaagagc

SEQ ID NO: 49605 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacatcaacagccgcgggccgagcttcagcagcggcctggtgccgttaagcttgcgcgagacgtcggaagagc

SEQ ID NO: 49606 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctatcagccgcgggccgagcttcagcagcggcctggtgccgttaagcttgcgcgagacgtcggaagagc

SEQ ID NO: 49607 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacatccgcgggccgagcttcagcagcggcctggtgccgttaagcttgcgcgagacgtcggaagagc

SEQ ID NO: 49608 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcatcgggccgagcttcagcagcggcctggtgccgttaagcttgcgcgagacgtcggaagagc

SEQ ID NO: 49609 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcatcccgagcttcagcagcggcctggtgccgttaagcttgcgcgagacgtcggaagagc

SEQ ID NO: 49610 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggatcagcttcagcagcggcctggtgccgttaagcttgcgcgagacgtcggaagagc

SEQ ID NO: 49611 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgatcttcagcagcggcctggtgccgttaagcttgcgcgagacgtcggaagagc

SEQ ID NO: 49612 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcatcagcagcggcctggtgccgttaagcttgcgcgagacgtcggaagagc

SEQ ID NO: 49613 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcatcagcggcctggtgccgttaagcttgcgcgagacgtcggaagagc

SEQ ID NO: 49614 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcatcggcctggtgccgttaagcttgcgcgagacgtcggaagagc

SEQ ID NO: 49615 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcatcctggtgccgttaagcttgcgcgagacgtcggaagagc

SEQ ID NO: 49616 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcatcgtgccgttaagcttgcgcgagacgtcggaagagc

SEQ ID NO: 49617 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgatcccgttaagcttgcgcgagacgtcggaagagc

SEQ ID NO: 49618 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgatcttaagcttgcgcgagacgtcggaagagc

SEQ ID NO: 49619 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgatcagcttgcgcgagacgtcggaagagc

SEQ ID NO: 49620 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaatcttgcgcgagacgtcggaagagc

SEQ ID NO: 49621 - RNA, 293 nt, synthetic construct
  source 1..293: mol_type = other RNA
cgctcttccgcgtctcgtcttcaggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49622 - RNA, 293 nt, synthetic construct
  source 1..293: mol_type = other RNA
cgctcttccgcgtctcgtcttcatgagggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49623 - RNA, 293 nt, synthetic construct
  source 1..293: mol_type = other RNA
cgctcttccgcgtctcgtcttcatgaacaggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49624 - RNA, 293 nt, synthetic construct
  source 1..293: mol_type = other RNA
cgctcttccgcgtctcgtcttcatgaacgagagggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49625 - RNA, 293 nt, synthetic construct
  source 1..293: mol_type = other RNA
cgctcttccgcgtctcgtcttcatgaacgagaagagggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49626 - RNA, 293 nt, synthetic construct
  source 1..293: mol_type = other RNA
cgctcttccgcgtctcgtcttcatgaacgagaaggagaggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49627 - RNA, 293 nt, synthetic construct
  source 1..293: mol_type = other RNA
cgctcttccgcgtctcgtcttcatgaacgagaaggaggacaggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49628 - RNA, 293 nt, synthetic construct
  source 1..293: mol_type = other RNA
cgctcttccgcgtctcgtcttcatgaacgagaaggaggacatcaggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49629 - RNA, 293 nt, synthetic construct
  source 1..293: mol_type = other RNA
cgctcttccgcgtctcgtcttcatgaacgagaaggaggacatcctgaggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49630 - RNA, 293 nt, synthetic construct
  source 1..293: mol_type = other RNA
cgctcttccgcgtctcgtcttcatgaacgagaaggaggacatcctgtggaggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49631 - RNA, 293 nt, synthetic construct
  source 1..293: mol_type = other RNA
cgctcttccgcgtctcgtcttcatgaacgagaaggaggacatcctgtggtgcagggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49632 - RNA, 293 nt, synthetic construct
  source 1..293: mol_type = other RNA
cgctcttccgcgtctcgtcttcatgaacgagaaggaggacatcctgtggtgcactaggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49633 - RNA, 293 nt, synthetic construct
  source 1..293: mol_type = other RNA
cgctcttccgcgtctcgtcttcatgaacgagaaggaggacatcctgtggtgcactgaaagggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49634 - RNA, 293 nt, synthetic construct
  source 1..293: mol_type = other RNA
cgctcttccgcgtctcgtcttcatgaacgagaaggaggacatcctgtggtgcactgaaatgaggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49635 - RNA, 293 nt, synthetic construct; identical to SEQ ID NO: 49292
  source 1..293: mol_type = other RNA

SEQ ID NO: 49636 - RNA, 293 nt, synthetic construct
  source 1..293: mol_type = other RNA
cgctcttccgcgtctcgtcttcatgaacgagaaggaggacatcctgtggtgcactgaaatggaaaggaggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49637 - RNA, 293 nt, synthetic construct
  source 1..293: mol_type = other RNA
cgctcttccgcgtctcgtcttcatgaacgagaaggaggacatcctgtggtgcactgaaatggaaagggtgaggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49638 - RNA, 293 nt, synthetic construct
  source 1..293: mol_type = other RNA
cgctcttccgcgtctcgtcttcatgaacgagaaggaggacatcctgtggtgcactgaaatggaaagggtgtttaggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49639 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcaggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49640 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcagggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49641 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccaggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49642 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcaggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49643 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacaggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49644 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacagggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49645 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaagggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49646 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacaggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49647 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgaggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49648 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49649 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacaggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49650 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgaggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49651 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcaggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49652 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcagggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49653 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49654 - RNA, 293 nt, synthetic construct; identical to SEQ ID NO: 49292
  source 1..293: mol_type = other RNA

SEQ ID NO: 49655 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49656 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49657 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49658 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49659 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49660 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcaggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49661 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggaggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49662 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49663 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49664 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49665 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgagggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49666 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49667 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49668 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcaggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49669 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49670 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49671 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcagggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49672 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49673 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaggctgaaggaatattttgcttgtgtgtctagcggcaatagtaacgctaacagccgcgggccgagcttcagcagcggcctggtgccgttaagcttgcgcgagacgtcggaagagc

SEQ ID NO: 49674 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaggaaggaatattttgcttgtgtgtctagcggcaatagtaacgctaacagccgcgggccgagcttcagcagcggcctggtgccgttaagcttgcgcgagacgtcggaagagc

SEQ ID NO: 49675 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgagggaatattttgcttgtgtgtctagcggcaatagtaacgctaacagccgcgggccgagcttcagcagcggcctggtgccgttaagcttgcgcgagacgtcggaagagc

SEQ ID NO: 49676 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagaggtattttgcttgtgtgtctagcggcaatagtaacgctaacagccgcgggccgagcttcagcagcggcctggtgccgttaagcttgcgcgagacgtcggaagagc

SEQ ID NO: 49677 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaaggtttgcttgtgtgtctagcggcaatagtaacgctaacagccgcgggccgagcttcagcagcggcctggtgccgttaagcttgcgcgagacgtcggaagagc

SEQ ID NO: 49678 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatagggcttgtgtgtctagcggcaatagtaacgctaacagccgcgggccgagcttcagcagcggcctggtgccgttaagcttgcgcgagacgtcggaagagc

SEQ ID NO: 49679 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttaggtgtgtgtctagcggcaatagtaacgctaacagccgcgggccgagcttcagcagcggcctggtgccgttaagcttgcgcgagacgtcggaagagc

SEQ ID NO: 49680 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctagggtgtctagcggcaatagtaacgctaacagccgcgggccgagcttcagcagcggcctggtgccgttaagcttgcgcgagacgtcggaagagc

SEQ ID NO: 49681 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtaggtctagcggcaatagtaacgctaacagccgcgggccgagcttcagcagcggcctggtgccgttaagcttgcgcgagacgtcggaagagc

SEQ ID NO: 49682 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaggagcggcaatagtaacgctaacagccgcgggccgagcttcagcagcggcctggtgccgttaagcttgcgcgagacgtcggaagagc

SEQ ID NO: 49683 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaggggcaatagtaacgctaacagccgcgggccgagcttcagcagcggcctggtgccgttaagcttgcgcgagacgtcggaagagc

SEQ ID NO: 49684 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaggaatagtaacgctaacagccgcgggccgagcttcagcagcggcctggtgccgttaagcttgcgcgagacgtcggaagagc

SEQ ID NO: 49685 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaggagtaacgctaacagccgcgggccgagcttcagcagcggcctggtgccgttaagcttgcgcgagacgtcggaagagc

SEQ ID NO: 49686 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataggaacgctaacagccgcgggccgagcttcagcagcggcctggtgccgttaagcttgcgcgagacgtcggaagagc

SEQ ID NO: 49687 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtagggctaacagccgcgggccgagcttcagcagcggcctggtgccgttaagcttgcgcgagacgtcggaagagc

SEQ ID NO: 49688 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaggaacagccgcgggccgagcttcagcagcggcctggtgccgttaagcttgcgcgagacgtcggaagagc

SEQ ID NO: 49689 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaggagccgcgggccgagcttcagcagcggcctggtgccgttaagcttgcgcgagacgtcggaagagc

SEQ ID NO: 49690 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaggcgcgggccgagcttcagcagcggcctggtgccgttaagcttgcgcgagacgtcggaagagc

SEQ ID NO: 49691 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcagggggccgagcttcagcagcggcctggtgccgttaagcttgcgcgagacgtcggaagagc

SEQ ID NO: 49692 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaggccgagcttcagcagcggcctggtgccgttaagcttgcgcgagacgtcggaagagc

SEQ ID NO: 49693 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaggagcttcagcagcggcctggtgccgttaagcttgcgcgagacgtcggaagagc

SEQ ID NO: 49694 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaggttcagcagcggcctggtgccgttaagcttgcgcgagacgtcggaagagc

SEQ ID NO: 49695 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaggagcagcggcctggtgccgttaagcttgcgcgagacgtcggaagagc

SEQ ID NO: 49696 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaggagcggcctggtgccgttaagcttgcgcgagacgtcggaagagc

SEQ ID NO: 49697 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaggggcctggtgccgttaagcttgcgcgagacgtcggaagagc

SEQ ID NO: 49698 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaggctggtgccgttaagcttgcgcgagacgtcggaagagc

SEQ ID NO: 49699 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcagggtgccgttaagcttgcgcgagacgtcggaagagc

SEQ ID NO: 49700 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaggccgttaagcttgcgcgagacgtcggaagagc

SEQ ID NO: 49701 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaggttaagcttgcgcgagacgtcggaagagc

SEQ ID NO: 49702 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaggagcttgcgcgagacgtcggaagagc

SEQ ID NO: 49703 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaggttgcgcgagacgtcggaagagc

SEQ ID NO: 49704 - RNA, 293 nt, synthetic construct
  source 1..293: mol_type = other RNA
cgctcttccgcgtctcgtcttcagcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49705 - RNA, 293 nt, synthetic construct
  source 1..293: mol_type = other RNA
cgctcttccgcgtctcgtcttcatgagcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49706 - RNA, 293 nt, synthetic construct
  source 1..293: mol_type = other RNA
cgctcttccgcgtctcgtcttcatgaacagcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49707 - RNA, 293 nt, synthetic construct
  source 1..293: mol_type = other RNA
cgctcttccgcgtctcgtcttcatgaacgagagcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49708 - RNA, 293 nt, synthetic construct
  source 1..293: mol_type = other RNA
cgctcttccgcgtctcgtcttcatgaacgagaagagcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49709 - RNA, 293 nt, synthetic construct
  source 1..293: mol_type = other RNA
cgctcttccgcgtctcgtcttcatgaacgagaaggagagcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49710 - RNA, 293 nt, synthetic construct
  source 1..293: mol_type = other RNA
cgctcttccgcgtctcgtcttcatgaacgagaaggaggacagcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49711 - RNA, 293 nt, synthetic construct
  source 1..293: mol_type = other RNA
cgctcttccgcgtctcgtcttcatgaacgagaaggaggacatcagctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49712 - RNA, 293 nt, synthetic construct
  source 1..293: mol_type = other RNA
cgctcttccgcgtctcgtcttcatgaacgagaaggaggacatcctgagctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49713 - RNA, 293 nt, synthetic construct
  source 1..293: mol_type = other RNA
cgctcttccgcgtctcgtcttcatgaacgagaaggaggacatcctgtggagcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49714 - RNA, 293 nt, synthetic construct
  source 1..293: mol_type = other RNA
cgctcttccgcgtctcgtcttcatgaacgagaaggaggacatcctgtggtgcagcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49715 - RNA, 293 nt, synthetic construct
  source 1..293: mol_type = other RNA
cgctcttccgcgtctcgtcttcatgaacgagaaggaggacatcctgtggtgcactagcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49716 - RNA, 293 nt, synthetic construct
  source 1..293: mol_type = other RNA
cgctcttccgcgtctcgtcttcatgaacgagaaggaggacatcctgtggtgcactgaaagcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49717 - RNA, 293 nt, synthetic construct
  source 1..293: mol_type = other RNA
cgctcttccgcgtctcgtcttcatgaacgagaaggaggacatcctgtggtgcactgaaatgagcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49718 - RNA, 293 nt, synthetic construct
  source 1..293: mol_type = other RNA
cgctcttccgcgtctcgtcttcatgaacgagaaggaggacatcctgtggtgcactgaaatggaaagcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49719 - RNA, 293 nt, synthetic construct
  source 1..293: mol_type = other RNA
cgctcttccgcgtctcgtcttcatgaacgagaaggaggacatcctgtggtgcactgaaatggaaaggagctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49720 - RNA, 293 nt, synthetic construct
  source 1..293: mol_type = other RNA
cgctcttccgcgtctcgtcttcatgaacgagaaggaggacatcctgtggtgcactgaaatggaaagggtgagcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49721 - RNA, 293 nt, synthetic construct
  source 1..293: mol_type = other RNA
cgctcttccgcgtctcgtcttcatgaacgagaaggaggacatcctgtggtgcactgaaatggaaagggtgtttagcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49722 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcagccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49723 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcagcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49724 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccagccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49725 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcagctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49726 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacagcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49727 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacagcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49728 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaagcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49729 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacagctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49730 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgagcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49731 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccagcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49732 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacagcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49733 - RNA, 293 nt, synthetic construct; identical to SEQ ID NO: 49292
  source 1..293: mol_type = other RNA

SEQ ID NO: 49734 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcagcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49735 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcagcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49736 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgagcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49737 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49738 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggagcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49739 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49740 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaagcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49741 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgagcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49742 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgagccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49743 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcagctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49744 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggagctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49745 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgagcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49746 - RNA, 293 nt, synthetic construct; identical to SEQ ID NO: 49292
  source 1..293: mol_type = other RNA

SEQ ID NO: 49747 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcagcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49748 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgagcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49749 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgagcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49750 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcagccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49751 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcagccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49752 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcagcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49753 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacagcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49754 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcagcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49755 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcagcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49756 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctagcctgaaggaatattttgcttgtgtgtctagcggcaatagtaacgctaacagccgcgggccgagcttcagcagcggcctggtgccgttaagcttgcgcgagacgtcggaagagc

SEQ ID NO: 49757 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgagcaaggaatattttgcttgtgtgtctagcggcaatagtaacgctaacagccgcgggccgagcttcagcagcggcctggtgccgttaagcttgcgcgagacgtcggaagagc

SEQ ID NO: 49758 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgagcgaatattttgcttgtgtgtctagcggcaatagtaacgctaacagccgcgggccgagcttcagcagcggcctggtgccgttaagcttgcgcgagacgtcggaagagc

SEQ ID NO: 49759 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagagctattttgcttgtgtgtctagcggcaatagtaacgctaacagccgcgggccgagcttcagcagcggcctggtgccgttaagcttgcgcgagacgtcggaagagc

SEQ ID NO: 49760 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaagctttgcttgtgtgtctagcggcaatagtaacgctaacagccgcgggccgagcttcagcagcggcctggtgccgttaagcttgcgcgagacgtcggaagagc

SEQ ID NO: 49761 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatagcgcttgtgtgtctagcggcaatagtaacgctaacagccgcgggccgagcttcagcagcggcctggtgccgttaagcttgcgcgagacgtcggaagagc

SEQ ID NO: 49762 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttagctgtgtgtctagcggcaatagtaacgctaacagccgcgggccgagcttcagcagcggcctggtgccgttaagcttgcgcgagacgtcggaagagc

SEQ ID NO: 49763 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctagcgtgtctagcggcaatagtaacgctaacagccgcgggccgagcttcagcagcggcctggtgccgttaagcttgcgcgagacgtcggaagagc

SEQ ID NO: 49764 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtagctctagcggcaatagtaacgctaacagccgcgggccgagcttcagcagcggcctggtgccgttaagcttgcgcgagacgtcggaagagc

SEQ ID NO: 49765 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgagcagcggcaatagtaacgctaacagccgcgggccgagcttcagcagcggcctggtgccgttaagcttgcgcgagacgtcggaagagc

SEQ ID NO: 49766 - RNA, 293 nt, synthetic construct; identical to SEQ ID NO: 49292
  source 1..293: mol_type = other RNA

SEQ ID NO: 49767 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcagcaatagtaacgctaacagccgcgggccgagcttcagcagcggcctggtgccgttaagcttgcgcgagacgtcggaagagc

SEQ ID NO: 49768 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcagcagtaacgctaacagccgcgggccgagcttcagcagcggcctggtgccgttaagcttgcgcgagacgtcggaagagc

SEQ ID NO: 49769 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagcaacgctaacagccgcgggccgagcttcagcagcggcctggtgccgttaagcttgcgcgagacgtcggaagagc

SEQ ID NO: 49770 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtagcgctaacagccgcgggccgagcttcagcagcggcctggtgccgttaagcttgcgcgagacgtcggaagagc

SEQ ID NO: 49771 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacagcaacagccgcgggccgagcttcagcagcggcctggtgccgttaagcttgcgcgagacgtcggaagagc

SEQ ID NO: 49772 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctagcagccgcgggccgagcttcagcagcggcctggtgccgttaagcttgcgcgagacgtcggaagagc

SEQ ID NO: 49773 - RNA, 293 nt, synthetic construct; identical to SEQ ID NO: 49292
  source 1..293: mol_type = other RNA

SEQ ID NO: 49774 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcagcgggccgagcttcagcagcggcctggtgccgttaagcttgcgcgagacgtcggaagagc

SEQ ID NO: 49775 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcagcccgagcttcagcagcggcctggtgccgttaagcttgcgcgagacgtcggaagagc

SEQ ID NO: 49776 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggagcagcttcagcagcggcctggtgccgttaagcttgcgcgagacgtcggaagagc

SEQ ID NO: 49777 - RNA, 293 nt, synthetic construct; identical to SEQ ID NO: 49292
  source 1..293: mol_type = other RNA

SEQ ID NO: 49778 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcagcagcagcggcctggtgccgttaagcttgcgcgagacgtcggaagagc

SEQ ID NO: 49779 - RNA, 293 nt, synthetic construct; identical to SEQ ID NO: 49292
  source 1..293: mol_type = other RNA

SEQ ID NO: 49780 - RNA, 293 nt, synthetic construct; identical to SEQ ID NO: 49292
  source 1..293: mol_type = other RNA

SEQ ID NO: 49781 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcagcctggtgccgttaagcttgcgcgagacgtcggaagagc

SEQ ID NO: 49782 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcagcgtgccgttaagcttgcgcgagacgtcggaagagc

SEQ ID NO: 49783 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgagcccgttaagcttgcgcgagacgtcggaagagc

SEQ ID NO: 49784 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgagcttaagcttgcgcgagacgtcggaagagc

SEQ ID NO: 49785 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgagcagcttgcgcgagacgtcggaagagc

SEQ ID NO: 49786 - RNA, 293 nt, synthetic construct; identical to SEQ ID NO: 49292
  source 1..293: mol_type = other RNA

SEQ ID NO: 49787 - RNA, 293 nt, synthetic construct
  source 1..293: mol_type = other RNA
cgctcttccgcgtctcgtcttcacgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49788 - RNA, 293 nt, synthetic construct
  source 1..293: mol_type = other RNA
cgctcttccgcgtctcgtcttcatgacggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49789 - RNA, 293 nt, synthetic construct
  source 1..293: mol_type = other RNA
cgctcttccgcgtctcgtcttcatgaacacgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49790 - RNA, 293 nt, synthetic construct
  source 1..293: mol_type = other RNA
cgctcttccgcgtctcgtcttcatgaacgagacggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49791 - RNA, 293 nt, synthetic construct
  source 1..293: mol_type = other RNA
cgctcttccgcgtctcgtcttcatgaacgagaagacggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49792 - RNA, 293 nt, synthetic construct
  source 1..293: mol_type = other RNA
cgctcttccgcgtctcgtcttcatgaacgagaaggagacgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49793 - RNA, 293 nt, synthetic construct
  source 1..293: mol_type = other RNA
cgctcttccgcgtctcgtcttcatgaacgagaaggaggacacgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49794 - RNA, 293 nt, synthetic construct
  source 1..293: mol_type = other RNA
cgctcttccgcgtctcgtcttcatgaacgagaaggaggacatcacgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49795 - RNA, 293 nt, synthetic construct
  source 1..293: mol_type = other RNA
cgctcttccgcgtctcgtcttcatgaacgagaaggaggacatcctgacgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49796 - RNA, 293 nt, synthetic construct
  source 1..293: mol_type = other RNA
cgctcttccgcgtctcgtcttcatgaacgagaaggaggacatcctgtggacgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49797 - RNA, 293 nt, synthetic construct
  source 1..293: mol_type = other RNA
cgctcttccgcgtctcgtcttcatgaacgagaaggaggacatcctgtggtgcacggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49798 - RNA, 293 nt, synthetic construct
  source 1..293: mol_type = other RNA
cgctcttccgcgtctcgtcttcatgaacgagaaggaggacatcctgtggtgcactacgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49799 - RNA, 293 nt, synthetic construct
  source 1..293: mol_type = other RNA
cgctcttccgcgtctcgtcttcatgaacgagaaggaggacatcctgtggtgcactgaaacggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49800 - RNA, 293 nt, synthetic construct
  source 1..293: mol_type = other RNA
cgctcttccgcgtctcgtcttcatgaacgagaaggaggacatcctgtggtgcactgaaatgacgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49801 - RNA, 293 nt, synthetic construct
  source 1..293: mol_type = other RNA
cgctcttccgcgtctcgtcttcatgaacgagaaggaggacatcctgtggtgcactgaaatggaaacggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49802 - RNA, 293 nt, synthetic construct
  source 1..293: mol_type = other RNA
cgctcttccgcgtctcgtcttcatgaacgagaaggaggacatcctgtggtgcactgaaatggaaaggacgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49803 - RNA, 293 nt, synthetic construct
  source 1..293: mol_type = other RNA
cgctcttccgcgtctcgtcttcatgaacgagaaggaggacatcctgtggtgcactgaaatggaaagggtgacgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49804 - RNA, 293 nt, synthetic construct
  source 1..293: mol_type = other RNA
cgctcttccgcgtctcgtcttcatgaacgagaaggaggacatcctgtggtgcactgaaatggaaagggtgtttacgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49805 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcacgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49806 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcacggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49807 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccacgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49808 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcacgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49809 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacacgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49810 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49811 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaacggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49812 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacacgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49813 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgacgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49814 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccacgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49815 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacacgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49816 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgacgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49817 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcacgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49818 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcacggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49819 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgacgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49820 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgacgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49821 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggacgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49822 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagacgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49823 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaacgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49824 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgacgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49825 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgacgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49826 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcacgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49827 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggacgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49828 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgacgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49829 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggacggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49830 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcacgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49831 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgacggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49832 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgacgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49833 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcacgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49834 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcacgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49835 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcacgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49836 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacacgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49837 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcacggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49838 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcacgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49839 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctacgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49840 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgacgaaggaatattttgcttgtgtgtctagcggcaatagtaacgctaacagccgcgggccgagcttcagcagcggcctggtgccgttaagcttgcgcgagacgtcggaagagc

SEQ ID NO: 49841 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgacggaatattttgcttgtgtgtctagcggcaatagtaacgctaacagccgcgggccgagcttcagcagcggcctggtgccgttaagcttgcgcgagacgtcggaagagc

SEQ ID NO: 49842 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagacgtattttgcttgtgtgtctagcggcaatagtaacgctaacagccgcgggccgagcttcagcagcggcctggtgccgttaagcttgcgcgagacgtcggaagagc

SEQ ID NO: 49843 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaacgtttgcttgtgtgtctagcggcaatagtaacgctaacagccgcgggccgagcttcagcagcggcctggtgccgttaagcttgcgcgagacgtcggaagagc

SEQ ID NO: 49844 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatacggcttgtgtgtctagcggcaatagtaacgctaacagccgcgggccgagcttcagcagcggcctggtgccgttaagcttgcgcgagacgtcggaagagc

SEQ ID NO: 49845 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttacgtgtgtgtctagcggcaatagtaacgctaacagccgcgggccgagcttcagcagcggcctggtgccgttaagcttgcgcgagacgtcggaagagc

SEQ ID NO: 49846 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctacggtgtctagcggcaatagtaacgctaacagccgcgggccgagcttcagcagcggcctggtgccgttaagcttgcgcgagacgtcggaagagc

SEQ ID NO: 49847 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtacgtctagcggcaatagtaacgctaacagccgcgggccgagcttcagcagcggcctggtgccgttaagcttgcgcgagacgtcggaagagc

SEQ ID NO: 49848 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgacgagcggcaatagtaacgctaacagccgcgggccgagcttcagcagcggcctggtgccgttaagcttgcgcgagacgtcggaagagc

SEQ ID NO: 49849 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctacgggcaatagtaacgctaacagccgcgggccgagcttcagcagcggcctggtgccgttaagcttgcgcgagacgtcggaagagc

SEQ ID NO: 49850 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcacgaatagtaacgctaacagccgcgggccgagcttcagcagcggcctggtgccgttaagcttgcgcgagacgtcggaagagc

SEQ ID NO: 49851 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcacgagtaacgctaacagccgcgggccgagcttcagcagcggcctggtgccgttaagcttgcgcgagacgtcggaagagc

SEQ ID NO: 49852 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatacgaacgctaacagccgcgggccgagcttcagcagcggcctggtgccgttaagcttgcgcgagacgtcggaagagc

SEQ ID NO: 49853 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtacggctaacagccgcgggccgagcttcagcagcggcctggtgccgttaagcttgcgcgagacgtcggaagagc

SEQ ID NO: 49854 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacacgaacagccgcgggccgagcttcagcagcggcctggtgccgttaagcttgcgcgagacgtcggaagagc

SEQ ID NO: 49855 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctacgagccgcgggccgagcttcagcagcggcctggtgccgttaagcttgcgcgagacgtcggaagagc

SEQ ID NO: 49856 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacacgcgcgggccgagcttcagcagcggcctggtgccgttaagcttgcgcgagacgtcggaagagc

SEQ ID NO: 49857 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcacggggccgagcttcagcagcggcctggtgccgttaagcttgcgcgagacgtcggaagagc

SEQ ID NO: 49858 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcacgccgagcttcagcagcggcctggtgccgttaagcttgcgcgagacgtcggaagagc

SEQ ID NO: 49859 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggacgagcttcagcagcggcctggtgccgttaagcttgcgcgagacgtcggaagagc

SEQ ID NO: 49860 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgacgttcagcagcggcctggtgccgttaagcttgcgcgagacgtcggaagagc

SEQ ID NO: 49861 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcacgagcagcggcctggtgccgttaagcttgcgcgagacgtcggaagagc

SEQ ID NO: 49862 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcacgagcggcctggtgccgttaagcttgcgcgagacgtcggaagagc

SEQ ID NO: 49863 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcacgggcctggtgccgttaagcttgcgcgagacgtcggaagagc

SEQ ID NO: 49864 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcacgctggtgccgttaagcttgcgcgagacgtcggaagagc

SEQ ID NO: 49865 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcacggtgccgttaagcttgcgcgagacgtcggaagagc

SEQ ID NO: 49866 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgacgccgttaagcttgcgcgagacgtcggaagagc

SEQ ID NO: 49867 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgacgttaagcttgcgcgagacgtcggaagagc

SEQ ID NO: 49868 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgacgagcttgcgcgagacgtcggaagagc

SEQ ID NO: 49869 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaacgttgcgcgagacgtcggaagagc

SEQ ID NO: 49870 - RNA, 293 nt, synthetic construct
  source 1..293: mol_type = other RNA
cgctcttccgcgtctcgtcttcaccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49871 - RNA, 293 nt, synthetic construct
  source 1..293: mol_type = other RNA
cgctcttccgcgtctcgtcttcatgaccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49872 - RNA, 293 nt, synthetic construct
  source 1..293: mol_type = other RNA
cgctcttccgcgtctcgtcttcatgaacaccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49873 - RNA, 293 nt, synthetic construct
  source 1..293: mol_type = other RNA
cgctcttccgcgtctcgtcttcatgaacgagaccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49874 - RNA, 293 nt, synthetic construct
  source 1..293: mol_type = other RNA
cgctcttccgcgtctcgtcttcatgaacgagaagaccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49875 - RNA, 293 nt, synthetic construct
  source 1..293: mol_type = other RNA
cgctcttccgcgtctcgtcttcatgaacgagaaggagaccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49876 - RNA, 293 nt, synthetic construct
  source 1..293: mol_type = other RNA
cgctcttccgcgtctcgtcttcatgaacgagaaggaggacaccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49877 - RNA, 293 nt, synthetic construct
  source 1..293: mol_type = other RNA
cgctcttccgcgtctcgtcttcatgaacgagaaggaggacatcacctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49878 - RNA, 293 nt, synthetic construct
  source 1..293: mol_type = other RNA
cgctcttccgcgtctcgtcttcatgaacgagaaggaggacatcctgacctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49879 - RNA, 293 nt, synthetic construct
  source 1..293: mol_type = other RNA
cgctcttccgcgtctcgtcttcatgaacgagaaggaggacatcctgtggaccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49880 - RNA, 293 nt, synthetic construct
  source 1..293: mol_type = other RNA
cgctcttccgcgtctcgtcttcatgaacgagaaggaggacatcctgtggtgcaccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49881 - RNA, 293 nt, synthetic construct
  source 1..293: mol_type = other RNA
cgctcttccgcgtctcgtcttcatgaacgagaaggaggacatcctgtggtgcactaccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49882 - RNA, 293 nt, synthetic construct
  source 1..293: mol_type = other RNA
cgctcttccgcgtctcgtcttcatgaacgagaaggaggacatcctgtggtgcactgaaaccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49883 - RNA, 293 nt, synthetic construct
  source 1..293: mol_type = other RNA
cgctcttccgcgtctcgtcttcatgaacgagaaggaggacatcctgtggtgcactgaaatgaccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49884 - RNA, 293 nt, synthetic construct
  source 1..293: mol_type = other RNA
cgctcttccgcgtctcgtcttcatgaacgagaaggaggacatcctgtggtgcactgaaatggaaaccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49885 - RNA, 293 nt, synthetic construct
  source 1..293: mol_type = other RNA
cgctcttccgcgtctcgtcttcatgaacgagaaggaggacatcctgtggtgcactgaaatggaaaggacctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49886 - RNA, 293 nt, synthetic construct
  source 1..293: mol_type = other RNA
cgctcttccgcgtctcgtcttcatgaacgagaaggaggacatcctgtggtgcactgaaatggaaagggtgaccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49887 - RNA, 293 nt, synthetic construct
  source 1..293: mol_type = other RNA
cgctcttccgcgtctcgtcttcatgaacgagaaggaggacatcctgtggtgcactgaaatggaaagggtgtttaccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49888 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcacccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49889 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcaccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49890 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccacccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49891 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcacctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49892 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacaccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49893 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacaccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49894 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaaccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49895 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacacctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49896 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgaccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49897 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49898 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacaccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49899 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgacccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49900 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcaccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49901 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49902 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49903 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgacccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49904 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49905 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49906 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49907 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49908 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgacccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49909 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcacctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49910 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggacctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49911 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49912 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49913 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49914 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49915 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49916 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcacccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49917 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcacccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49918 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49919 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49920 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49921 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49922 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaccctgaaggaatattttgcttgtgtgtctagcggcaatagtaacgctaacagccgcgggccgagcttcagcagcggcctggtgccgttaagcttgcgcgagacgtcggaagagc

SEQ ID NO: 49923 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaccaaggaatattttgcttgtgtgtctagcggcaatagtaacgctaacagccgcgggccgagcttcagcagcggcctggtgccgttaagcttgcgcgagacgtcggaagagc

SEQ ID NO: 49924 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaccgaatattttgcttgtgtgtctagcggcaatagtaacgctaacagccgcgggccgagcttcagcagcggcctggtgccgttaagcttgcgcgagacgtcggaagagc

SEQ ID NO: 49925 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagacctattttgcttgtgtgtctagcggcaatagtaacgctaacagccgcgggccgagcttcagcagcggcctggtgccgttaagcttgcgcgagacgtcggaagagc

SEQ ID NO: 49926 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaacctttgcttgtgtgtctagcggcaatagtaacgctaacagccgcgggccgagcttcagcagcggcctggtgccgttaagcttgcgcgagacgtcggaagagc

SEQ ID NO: 49927 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatataccgcttgtgtgtctagcggcaatagtaacgctaacagccgcgggccgagcttcagcagcggcctggtgccgttaagcttgcgcgagacgtcggaagagc

SEQ ID NO: 49928 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttacctgtgtgtctagcggcaatagtaacgctaacagccgcgggccgagcttcagcagcggcctggtgccgttaagcttgcgcgagacgtcggaagagc

SEQ ID NO: 49929 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctaccgtgtctagcggcaatagtaacgctaacagccgcgggccgagcttcagcagcggcctggtgccgttaagcttgcgcgagacgtcggaagagc

SEQ ID NO: 49930 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtacctctagcggcaatagtaacgctaacagccgcgggccgagcttcagcagcggcctggtgccgttaagcttgcgcgagacgtcggaagagc

SEQ ID NO: 49931 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaccagcggcaatagtaacgctaacagccgcgggccgagcttcagcagcggcctggtgccgttaagcttgcgcgagacgtcggaagagc

SEQ ID NO: 49932 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaccggcaatagtaacgctaacagccgcgggccgagcttcagcagcggcctggtgccgttaagcttgcgcgagacgtcggaagagc

SEQ ID NO: 49933 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaccaatagtaacgctaacagccgcgggccgagcttcagcagcggcctggtgccgttaagcttgcgcgagacgtcggaagagc

SEQ ID NO: 49934 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaccagtaacgctaacagccgcgggccgagcttcagcagcggcctggtgccgttaagcttgcgcgagacgtcggaagagc

SEQ ID NO: 49935 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataccaacgctaacagccgcgggccgagcttcagcagcggcctggtgccgttaagcttgcgcgagacgtcggaagagc

SEQ ID NO: 49936 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaccgctaacagccgcgggccgagcttcagcagcggcctggtgccgttaagcttgcgcgagacgtcggaagagc

SEQ ID NO: 49937 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaccaacagccgcgggccgagcttcagcagcggcctggtgccgttaagcttgcgcgagacgtcggaagagc

SEQ ID NO: 49938 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaccagccgcgggccgagcttcagcagcggcctggtgccgttaagcttgcgcgagacgtcggaagagc

SEQ ID NO: 49939 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacacccgcgggccgagcttcagcagcggcctggtgccgttaagcttgcgcgagacgtcggaagagc

SEQ ID NO: 49940 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcaccgggccgagcttcagcagcggcctggtgccgttaagcttgcgcgagacgtcggaagagc

SEQ ID NO: 49941 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaccccgagcttcagcagcggcctggtgccgttaagcttgcgcgagacgtcggaagagc

SEQ ID NO: 49942 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaccagcttcagcagcggcctggtgccgttaagcttgcgcgagacgtcggaagagc

SEQ ID NO: 49943 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaccttcagcagcggcctggtgccgttaagcttgcgcgagacgtcggaagagc

SEQ ID NO: 49944 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaccagcagcggcctggtgccgttaagcttgcgcgagacgtcggaagagc

SEQ ID NO: 49945 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaccagcggcctggtgccgttaagcttgcgcgagacgtcggaagagc

SEQ ID NO: 49946 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaccggcctggtgccgttaagcttgcgcgagacgtcggaagagc

SEQ ID NO: 49947 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaccctggtgccgttaagcttgcgcgagacgtcggaagagc

SEQ ID NO: 49948 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaccgtgccgttaagcttgcgcgagacgtcggaagagc

SEQ ID NO: 49949 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaccccgttaagcttgcgcgagacgtcggaagagc

SEQ ID NO: 49950 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaccttaagcttgcgcgagacgtcggaagagc

SEQ ID NO: 49951 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaccagcttgcgcgagacgtcggaagagc

SEQ ID NO: 49952 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaccttgcgcgagacgtcggaagagc

SEQ ID NO: 49953 - RNA, 293 nt, synthetic construct
  source 1..293: mol_type = other RNA
cgctcttccgcgtctcgtcttctagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49954 - RNA, 293 nt, synthetic construct
  source 1..293: mol_type = other RNA
cgctcttccgcgtctcgtcttcatgtaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49955 - RNA, 293 nt, synthetic construct
  source 1..293: mol_type = other RNA
cgctcttccgcgtctcgtcttcatgaactagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49956 - RNA, 293 nt, synthetic construct
  source 1..293: mol_type = other RNA
cgctcttccgcgtctcgtcttcatgaacgagtaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49957 - RNA, 293 nt, synthetic construct
  source 1..293: mol_type = other RNA
cgctcttccgcgtctcgtcttcatgaacgagaagtaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49958 - RNA, 293 nt, synthetic construct
  source 1..293: mol_type = other RNA
cgctcttccgcgtctcgtcttcatgaacgagaaggagtagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49959 - RNA, 293 nt, synthetic construct
  source 1..293: mol_type = other RNA
cgctcttccgcgtctcgtcttcatgaacgagaaggaggactagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49960 - RNA, 293 nt, synthetic construct
  source 1..293: mol_type = other RNA
cgctcttccgcgtctcgtcttcatgaacgagaaggaggacatctagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49961 - RNA, 293 nt, synthetic construct
  source 1..293: mol_type = other RNA
cgctcttccgcgtctcgtcttcatgaacgagaaggaggacatcctgtagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49962 - RNA, 293 nt, synthetic construct
  source 1..293: mol_type = other RNA
cgctcttccgcgtctcgtcttcatgaacgagaaggaggacatcctgtggtagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49963 - RNA, 293 nt, synthetic construct
  source 1..293: mol_type = other RNA
cgctcttccgcgtctcgtcttcatgaacgagaaggaggacatcctgtggtgctaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49964 - RNA, 293 nt, synthetic construct
  source 1..293: mol_type = other RNA
cgctcttccgcgtctcgtcttcatgaacgagaaggaggacatcctgtggtgcacttagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49965 - RNA, 293 nt, synthetic construct
  source 1..293: mol_type = other RNA
cgctcttccgcgtctcgtcttcatgaacgagaaggaggacatcctgtggtgcactgaataggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49966 - RNA, 293 nt, synthetic construct
  source 1..293: mol_type = other RNA
cgctcttccgcgtctcgtcttcatgaacgagaaggaggacatcctgtggtgcactgaaatgtagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49967 - RNA, 293 nt, synthetic construct
  source 1..293: mol_type = other RNA
cgctcttccgcgtctcgtcttcatgaacgagaaggaggacatcctgtggtgcactgaaatggaataggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49968 - RNA, 293 nt, synthetic construct
  source 1..293: mol_type = other RNA
cgctcttccgcgtctcgtcttcatgaacgagaaggaggacatcctgtggtgcactgaaatggaaaggtagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49969 - RNA, 293 nt, synthetic construct
  source 1..293: mol_type = other RNA
cgctcttccgcgtctcgtcttcatgaacgagaaggaggacatcctgtggtgcactgaaatggaaagggtgtagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49970 - RNA, 293 nt, synthetic construct
  source 1..293: mol_type = other RNA
cgctcttccgcgtctcgtcttcatgaacgagaaggaggacatcctgtggtgcactgaaatggaaagggtgttttagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49971 - RNA, 293 nt, synthetic construct
  source 1..293: mol_type = other RNA
cgctcttccgcgtctcgtcttcatgaacgagaaggaggacatcctgtggtgcactgaaatggaaagggtgtttggctagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49972 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttctaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49973 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccctagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49974 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtctagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49975 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49976 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactactaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49977 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacataggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49978 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagactagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49979 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49980 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcctagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49981 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaactagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49982 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgtagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49983 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagctagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49984 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgctaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49985 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49986 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49987 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49988 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49989 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49990 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49991 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49992 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49993 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49994 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49995 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49996 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49997 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49998 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 49999 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50000 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50001 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50002 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50003 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50004 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50005 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttagctgaaggaatattttgcttgtgtgtctagcggcaatagtaacgctaacagccgcgggccgagcttcagcagcggcctggtgccgttaagcttgcgcgagacgtcggaagagc

SEQ ID NO: 50006 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtagaaggaatattttgcttgtgtgtctagcggcaatagtaacgctaacagccgcgggccgagcttcagcagcggcctggtgccgttaagcttgcgcgagacgtcggaagagc

SEQ ID NO: 50007 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtaggaatattttgcttgtgtgtctagcggcaatagtaacgctaacagccgcgggccgagcttcagcagcggcctggtgccgttaagcttgcgcgagacgtcggaagagc

SEQ ID NO: 50008 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtagtattttgcttgtgtgtctagcggcaatagtaacgctaacagccgcgggccgagcttcagcagcggcctggtgccgttaagcttgcgcgagacgtcggaagagc

SEQ ID NO: 50009 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatagtttgcttgtgtgtctagcggcaatagtaacgctaacagccgcgggccgagcttcagcagcggcctggtgccgttaagcttgcgcgagacgtcggaagagc

SEQ ID NO: 50010 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattaggcttgtgtgtctagcggcaatagtaacgctaacagccgcgggccgagcttcagcagcggcctggtgccgttaagcttgcgcgagacgtcggaagagc

SEQ ID NO: 50011 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttagtgtgtgtctagcggcaatagtaacgctaacagccgcgggccgagcttcagcagcggcctggtgccgttaagcttgcgcgagacgtcggaagagc

SEQ ID NO: 50012 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttaggtgtctagcggcaatagtaacgctaacagccgcgggccgagcttcagcagcggcctggtgccgttaagcttgcgcgagacgtcggaagagc

SEQ ID NO: 50013 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttagtctagcggcaatagtaacgctaacagccgcgggccgagcttcagcagcggcctggtgccgttaagcttgcgcgagacgtcggaagagc

SEQ ID NO: 50014 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtagagcggcaatagtaacgctaacagccgcgggccgagcttcagcagcggcctggtgccgttaagcttgcgcgagacgtcggaagagc

SEQ ID NO: 50015 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttagggcaatagtaacgctaacagccgcgggccgagcttcagcagcggcctggtgccgttaagcttgcgcgagacgtcggaagagc

SEQ ID NO: 50016 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctagaatagtaacgctaacagccgcgggccgagcttcagcagcggcctggtgccgttaagcttgcgcgagacgtcggaagagc

SEQ ID NO: 50017 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctagagtaacgctaacagccgcgggccgagcttcagcagcggcctggtgccgttaagcttgcgcgagacgtcggaagagc

SEQ ID NO: 50018 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattagaacgctaacagccgcgggccgagcttcagcagcggcctggtgccgttaagcttgcgcgagacgtcggaagagc

SEQ ID NO: 50019 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttaggctaacagccgcgggccgagcttcagcagcggcctggtgccgttaagcttgcgcgagacgtcggaagagc

SEQ ID NO: 50020 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactagaacagccgcgggccgagcttcagcagcggcctggtgccgttaagcttgcgcgagacgtcggaagagc

SEQ ID NO: 50021 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttagagccgcgggccgagcttcagcagcggcctggtgccgttaagcttgcgcgagacgtcggaagagc

SEQ ID NO: 50022 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactagcgcgggccgagcttcagcagcggcctggtgccgttaagcttgcgcgagacgtcggaagagc

SEQ ID NO: 50023 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctaggggccgagcttcagcagcggcctggtgccgttaagcttgcgcgagacgtcggaagagc

SEQ ID NO: 50024 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctagccgagcttcagcagcggcctggtgccgttaagcttgcgcgagacgtcggaagagc

SEQ ID NO: 50025 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtagagcttcagcagcggcctggtgccgttaagcttgcgcgagacgtcggaagagc

SEQ ID NO: 50026 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtagttcagcagcggcctggtgccgttaagcttgcgcgagacgtcggaagagc

SEQ ID NO: 50027 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctagagcagcggcctggtgccgttaagcttgcgcgagacgtcggaagagc

SEQ ID NO: 50028 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctagagcggcctggtgccgttaagcttgcgcgagacgtcggaagagc

SEQ ID NO: 50029 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctagggcctggtgccgttaagcttgcgcgagacgtcggaagagc

SEQ ID NO: 50030 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctagctggtgccgttaagcttgcgcgagacgtcggaagagc

SEQ ID NO: 50031 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctaggtgccgttaagcttgcgcgagacgtcggaagagc

SEQ ID NO: 50032 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtagccgttaagcttgcgcgagacgtcggaagagc

SEQ ID NO: 50033 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtagttaagcttgcgcgagacgtcggaagagc

SEQ ID NO: 50034 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtagagcttgcgcgagacgtcggaagagc

SEQ ID NO: 50035 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatagttgcgcgagacgtcggaagagc

SEQ ID NO: 50036 - RNA, 293 nt, synthetic construct
  source 1..293: mol_type = other RNA
cgctcttccgcgtctcgtcttctacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50037 - RNA, 293 nt, synthetic construct
  source 1..293: mol_type = other RNA
cgctcttccgcgtctcgtcttcatgtacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50038 - RNA, 293 nt, synthetic construct
  source 1..293: mol_type = other RNA
cgctcttccgcgtctcgtcttcatgaactacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50039 - RNA, 293 nt, synthetic construct
  source 1..293: mol_type = other RNA
cgctcttccgcgtctcgtcttcatgaacgagtacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50040 - RNA, 293 nt, synthetic construct
  source 1..293: mol_type = other RNA
cgctcttccgcgtctcgtcttcatgaacgagaagtacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50041 - RNA, 293 nt, synthetic construct
  source 1..293: mol_type = other RNA
cgctcttccgcgtctcgtcttcatgaacgagaaggagtacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50042 - RNA, 293 nt, synthetic construct
  source 1..293: mol_type = other RNA
cgctcttccgcgtctcgtcttcatgaacgagaaggaggactacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50043 - RNA, 293 nt, synthetic construct
  source 1..293: mol_type = other RNA
cgctcttccgcgtctcgtcttcatgaacgagaaggaggacatctactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50044 - RNA, 293 nt, synthetic construct
  source 1..293: mol_type = other RNA
cgctcttccgcgtctcgtcttcatgaacgagaaggaggacatcctgtactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50045 - RNA, 293 nt, synthetic construct
  source 1..293: mol_type = other RNA
cgctcttccgcgtctcgtcttcatgaacgagaaggaggacatcctgtggtacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50046 - RNA, 293 nt, synthetic construct
  source 1..293: mol_type = other RNA
cgctcttccgcgtctcgtcttcatgaacgagaaggaggacatcctgtggtgctacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50047 - RNA, 293 nt, synthetic construct
  source 1..293: mol_type = other RNA
cgctcttccgcgtctcgtcttcatgaacgagaaggaggacatcctgtggtgcacttacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50048 - RNA, 293 nt, synthetic construct
  source 1..293: mol_type = other RNA
cgctcttccgcgtctcgtcttcatgaacgagaaggaggacatcctgtggtgcactgaatacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50049 - RNA, 293 nt, synthetic construct
  source 1..293: mol_type = other RNA
cgctcttccgcgtctcgtcttcatgaacgagaaggaggacatcctgtggtgcactgaaatgtacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50050 - RNA, 293 nt, synthetic construct
  source 1..293: mol_type = other RNA
cgctcttccgcgtctcgtcttcatgaacgagaaggaggacatcctgtggtgcactgaaatggaatacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50051 - RNA, 293 nt, synthetic construct
  source 1..293: mol_type = other RNA
cgctcttccgcgtctcgtcttcatgaacgagaaggaggacatcctgtggtgcactgaaatggaaaggtactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50052 - RNA, 293 nt, synthetic construct
  source 1..293: mol_type = other RNA
cgctcttccgcgtctcgtcttcatgaacgagaaggaggacatcctgtggtgcactgaaatggaaagggtgtacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50053 - RNA, 293 nt, synthetic construct
  source 1..293: mol_type = other RNA
cgctcttccgcgtctcgtcttcatgaacgagaaggaggacatcctgtggtgcactgaaatggaaagggtgttttacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50054 - RNA, 293 nt, synthetic construct
  source 1..293: mol_type = other RNA
cgctcttccgcgtctcgtcttcatgaacgagaaggaggacatcctgtggtgcactgaaatggaaagggtgtttggctaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50055 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttctacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50056 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccctaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50057 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtctactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50058 - RNA, 293 nt, synthetic construct; identical to SEQ ID NO: 49292
  source 1..293: mol_type = other RNA

SEQ ID NO: 50059 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactactacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50060 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacatacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50061 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagactactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50062 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50063 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcctacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50064 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaactacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50065 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgtaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50066 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagctacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50067 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgctacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50068 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50069 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50070 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50071 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50072 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50073 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50074 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50075 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50076 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50077 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50078 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50079 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50080 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50081 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50082 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50083 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50084 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50085 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50086 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50087 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50088 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttacctgaaggaatattttgcttgtgtgtctagcggcaatagtaacgctaacagccgcgggccgagcttcagcagcggcctggtgccgttaagcttgcgcgagacgtcggaagagc

SEQ ID NO: 50089 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtacaaggaatattttgcttgtgtgtctagcggcaatagtaacgctaacagccgcgggccgagcttcagcagcggcctggtgccgttaagcttgcgcgagacgtcggaagagc

SEQ ID NO: 50090 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtacgaatattttgcttgtgtgtctagcggcaatagtaacgctaacagccgcgggccgagcttcagcagcggcctggtgccgttaagcttgcgcgagacgtcggaagagc

SEQ ID NO: 50091 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtactattttgcttgtgtgtctagcggcaatagtaacgctaacagccgcgggccgagcttcagcagcggcctggtgccgttaagcttgcgcgagacgtcggaagagc

SEQ ID NO: 50092 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatactttgcttgtgtgtctagcggcaatagtaacgctaacagccgcgggccgagcttcagcagcggcctggtgccgttaagcttgcgcgagacgtcggaagagc

SEQ ID NO: 50093 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattacgcttgtgtgtctagcggcaatagtaacgctaacagccgcgggccgagcttcagcagcggcctggtgccgttaagcttgcgcgagacgtcggaagagc

SEQ ID NO: 50094 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttactgtgtgtctagcggcaatagtaacgctaacagccgcgggccgagcttcagcagcggcctggtgccgttaagcttgcgcgagacgtcggaagagc

SEQ ID NO: 50095 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttacgtgtctagcggcaatagtaacgctaacagccgcgggccgagcttcagcagcggcctggtgccgttaagcttgcgcgagacgtcggaagagc

SEQ ID NO: 50096 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttactctagcggcaatagtaacgctaacagccgcgggccgagcttcagcagcggcctggtgccgttaagcttgcgcgagacgtcggaagagc

SEQ ID NO: 50097 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtacagcggcaatagtaacgctaacagccgcgggccgagcttcagcagcggcctggtgccgttaagcttgcgcgagacgtcggaagagc

SEQ ID NO: 50098 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttacggcaatagtaacgctaacagccgcgggccgagcttcagcagcggcctggtgccgttaagcttgcgcgagacgtcggaagagc

SEQ ID NO: 50099 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctacaatagtaacgctaacagccgcgggccgagcttcagcagcggcctggtgccgttaagcttgcgcgagacgtcggaagagc

SEQ ID NO: 50100 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctacagtaacgctaacagccgcgggccgagcttcagcagcggcctggtgccgttaagcttgcgcgagacgtcggaagagc

SEQ ID NO: 50101 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattacaacgctaacagccgcgggccgagcttcagcagcggcctggtgccgttaagcttgcgcgagacgtcggaagagc

SEQ ID NO: 50102 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttacgctaacagccgcgggccgagcttcagcagcggcctggtgccgttaagcttgcgcgagacgtcggaagagc

SEQ ID NO: 50103 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactacaacagccgcgggccgagcttcagcagcggcctggtgccgttaagcttgcgcgagacgtcggaagagc

SEQ ID NO: 50104 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttacagccgcgggccgagcttcagcagcggcctggtgccgttaagcttgcgcgagacgtcggaagagc

SEQ ID NO: 50105 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactaccgcgggccgagcttcagcagcggcctggtgccgttaagcttgcgcgagacgtcggaagagc

SEQ ID NO: 50106 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctacgggccgagcttcagcagcggcctggtgccgttaagcttgcgcgagacgtcggaagagc

SEQ ID NO: 50107 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctacccgagcttcagcagcggcctggtgccgttaagcttgcgcgagacgtcggaagagc

SEQ ID NO: 50108 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtacagcttcagcagcggcctggtgccgttaagcttgcgcgagacgtcggaagagc

SEQ ID NO: 50109 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtacttcagcagcggcctggtgccgttaagcttgcgcgagacgtcggaagagc

SEQ ID NO: 50110 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctacagcagcggcctggtgccgttaagcttgcgcgagacgtcggaagagc

SEQ ID NO: 50111 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctacagcggcctggtgccgttaagcttgcgcgagacgtcggaagagc

SEQ ID NO: 50112 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctacggcctggtgccgttaagcttgcgcgagacgtcggaagagc

SEQ ID NO: 50113 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctacctggtgccgttaagcttgcgcgagacgtcggaagagc

SEQ ID NO: 50114 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctacgtgccgttaagcttgcgcgagacgtcggaagagc

SEQ ID NO: 50115 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtacccgttaagcttgcgcgagacgtcggaagagc

SEQ ID NO: 50116 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtacttaagcttgcgcgagacgtcggaagagc

SEQ ID NO: 50117 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtacagcttgcgcgagacgtcggaagagc

SEQ ID NO: 50118 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatacttgcgcgagacgtcggaagagc

SEQ ID NO: 50119 - RNA, 293 nt, synthetic construct
  source 1..293: mol_type = other RNA
cgctcttccgcgtctcgtcttcttgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50120 - RNA, 293 nt, synthetic construct
  source 1..293: mol_type = other RNA
cgctcttccgcgtctcgtcttcatgttggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50121 - RNA, 293 nt, synthetic construct
  source 1..293: mol_type = other RNA
cgctcttccgcgtctcgtcttcatgaacttgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50122 - RNA, 293 nt, synthetic construct
  source 1..293: mol_type = other RNA
cgctcttccgcgtctcgtcttcatgaacgagttggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50123 - RNA, 293 nt, synthetic construct
  source 1..293: mol_type = other RNA
cgctcttccgcgtctcgtcttcatgaacgagaagttggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50124 - RNA, 293 nt, synthetic construct
  source 1..293: mol_type = other RNA
cgctcttccgcgtctcgtcttcatgaacgagaaggagttgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50125 - RNA, 293 nt, synthetic construct
  source 1..293: mol_type = other RNA
cgctcttccgcgtctcgtcttcatgaacgagaaggaggacttgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50126 - RNA, 293 nt, synthetic construct
  source 1..293: mol_type = other RNA
cgctcttccgcgtctcgtcttcatgaacgagaaggaggacatcttgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50127 - RNA, 293 nt, synthetic construct
  source 1..293: mol_type = other RNA
cgctcttccgcgtctcgtcttcatgaacgagaaggaggacatcctgttgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50128 - RNA, 293 nt, synthetic construct
  source 1..293: mol_type = other RNA
cgctcttccgcgtctcgtcttcatgaacgagaaggaggacatcctgtggttgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50129 - RNA, 293 nt, synthetic construct
  source 1..293: mol_type = other RNA
cgctcttccgcgtctcgtcttcatgaacgagaaggaggacatcctgtggtgcttggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50130 - RNA, 293 nt, synthetic construct
  source 1..293: mol_type = other RNA
cgctcttccgcgtctcgtcttcatgaacgagaaggaggacatcctgtggtgcactttgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50131 - RNA, 293 nt, synthetic construct
  source 1..293: mol_type = other RNA
cgctcttccgcgtctcgtcttcatgaacgagaaggaggacatcctgtggtgcactgaattggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50132 - RNA, 293 nt, synthetic construct
  source 1..293: mol_type = other RNA
cgctcttccgcgtctcgtcttcatgaacgagaaggaggacatcctgtggtgcactgaaatgttgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50133 - RNA, 293 nt, synthetic construct
  source 1..293: mol_type = other RNA
cgctcttccgcgtctcgtcttcatgaacgagaaggaggacatcctgtggtgcactgaaatggaattggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50134 - RNA, 293 nt, synthetic construct
  source 1..293: mol_type = other RNA
cgctcttccgcgtctcgtcttcatgaacgagaaggaggacatcctgtggtgcactgaaatggaaaggttgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50135 - RNA, 293 nt, synthetic construct
  source 1..293: mol_type = other RNA
cgctcttccgcgtctcgtcttcatgaacgagaaggaggacatcctgtggtgcactgaaatggaaagggtgttgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50136 - RNA, 293 nt, synthetic construct
  source 1..293: mol_type = other RNA
cgctcttccgcgtctcgtcttcatgaacgagaaggaggacatcctgtggtgcactgaaatggaaagggtgtttttgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50137 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50138 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcttggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50139 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccttgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50140 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcttgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50141 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacttgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50142 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacttggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50143 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacattggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50144 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacttgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50145 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgttgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50146 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccttgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50147 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacttgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50148 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgttgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50149 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcttgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50150 - RNA, 293 nt, synthetic construct; identical to SEQ ID NO: 49292
  source 1..293: mol_type = other RNA

SEQ ID NO: 50151 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgttgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50152 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgttgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50153 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggttgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50154 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagttgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50155 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagattgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50156 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgttgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50157 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgttgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50158 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcttgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50159 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggttgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50160 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgttgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50161 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggttggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50162 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcttgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50163 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgttggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50164 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgttgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50165 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcttgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50166 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcttgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50167 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcttgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50168 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacttgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50169 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50170 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcttgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50171 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctttgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50172 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgttgaaggaatattttgcttgtgtgtctagcggcaatagtaacgctaacagccgcgggccgagcttcagcagcggcctggtgccgttaagcttgcgcgagacgtcggaagagc

SEQ ID NO: 50173 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgttggaatattttgcttgtgtgtctagcggcaatagtaacgctaacagccgcgggccgagcttcagcagcggcctggtgccgttaagcttgcgcgagacgtcggaagagc

SEQ ID NO: 50174 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagttgtattttgcttgtgtgtctagcggcaatagtaacgctaacagccgcgggccgagcttcagcagcggcctggtgccgttaagcttgcgcgagacgtcggaagagc

SEQ ID NO: 50175 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaattgtttgcttgtgtgtctagcggcaatagtaacgctaacagccgcgggccgagcttcagcagcggcctggtgccgttaagcttgcgcgagacgtcggaagagc

SEQ ID NO: 50176 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttggcttgtgtgtctagcggcaatagtaacgctaacagccgcgggccgagcttcagcagcggcctggtgccgttaagcttgcgcgagacgtcggaagagc

SEQ ID NO: 50177 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttttgtgtgtgtctagcggcaatagtaacgctaacagccgcgggccgagcttcagcagcggcctggtgccgttaagcttgcgcgagacgtcggaagagc

SEQ ID NO: 50178 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctttggtgtctagcggcaatagtaacgctaacagccgcgggccgagcttcagcagcggcctggtgccgttaagcttgcgcgagacgtcggaagagc

SEQ ID NO: 50179 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtttgtctagcggcaatagtaacgctaacagccgcgggccgagcttcagcagcggcctggtgccgttaagcttgcgcgagacgtcggaagagc

SEQ ID NO: 50180 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgttgagcggcaatagtaacgctaacagccgcgggccgagcttcagcagcggcctggtgccgttaagcttgcgcgagacgtcggaagagc

SEQ ID NO: 50181 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctttgggcaatagtaacgctaacagccgcgggccgagcttcagcagcggcctggtgccgttaagcttgcgcgagacgtcggaagagc

SEQ ID NO: 50182 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcttgaatagtaacgctaacagccgcgggccgagcttcagcagcggcctggtgccgttaagcttgcgcgagacgtcggaagagc

SEQ ID NO: 50183 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcttgagtaacgctaacagccgcgggccgagcttcagcagcggcctggtgccgttaagcttgcgcgagacgtcggaagagc

SEQ ID NO: 50184 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatttgaacgctaacagccgcgggccgagcttcagcagcggcctggtgccgttaagcttgcgcgagacgtcggaagagc

SEQ ID NO: 50185 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtttggctaacagccgcgggccgagcttcagcagcggcctggtgccgttaagcttgcgcgagacgtcggaagagc

SEQ ID NO: 50186 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacttgaacagccgcgggccgagcttcagcagcggcctggtgccgttaagcttgcgcgagacgtcggaagagc

SEQ ID NO: 50187 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctttgagccgcgggccgagcttcagcagcggcctggtgccgttaagcttgcgcgagacgtcggaagagc

SEQ ID NO: 50188 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacttgcgcgggccgagcttcagcagcggcctggtgccgttaagcttgcgcgagacgtcggaagagc

SEQ ID NO: 50189 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcttggggccgagcttcagcagcggcctggtgccgttaagcttgcgcgagacgtcggaagagc

SEQ ID NO: 50190 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcttgccgagcttcagcagcggcctggtgccgttaagcttgcgcgagacgtcggaagagc

SEQ ID NO: 50191 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggttgagcttcagcagcggcctggtgccgttaagcttgcgcgagacgtcggaagagc

SEQ ID NO: 50192 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgttgttcagcagcggcctggtgccgttaagcttgcgcgagacgtcggaagagc

SEQ ID NO: 50193 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttgagcagcggcctggtgccgttaagcttgcgcgagacgtcggaagagc

SEQ ID NO: 50194 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcttgagcggcctggtgccgttaagcttgcgcgagacgtcggaagagc

SEQ ID NO: 50195 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcttgggcctggtgccgttaagcttgcgcgagacgtcggaagagc

SEQ ID NO: 50196 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcttgctggtgccgttaagcttgcgcgagacgtcggaagagc

SEQ ID NO: 50197 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcttggtgccgttaagcttgcgcgagacgtcggaagagc

SEQ ID NO: 50198 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgttgccgttaagcttgcgcgagacgtcggaagagc

SEQ ID NO: 50199 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgttgttaagcttgcgcgagacgtcggaagagc

SEQ ID NO: 50200 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttgagcttgcgcgagacgtcggaagagc

SEQ ID NO: 50201 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttattgttgcgcgagacgtcggaagagc

SEQ ID NO: 50202 - RNA, 293 nt, synthetic construct
  source 1..293: mol_type = other RNA
cgctcttccgcgtctcgtcttcttcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50203 - RNA, 293 nt, synthetic construct
  source 1..293: mol_type = other RNA
cgctcttccgcgtctcgtcttcatgttcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50204 - RNA, 293 nt, synthetic construct
  source 1..293: mol_type = other RNA
cgctcttccgcgtctcgtcttcatgaacttcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50205 - RNA, 293 nt, synthetic construct
  source 1..293: mol_type = other RNA
cgctcttccgcgtctcgtcttcatgaacgagttcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50206 - RNA, 293 nt, synthetic construct
  source 1..293: mol_type = other RNA
cgctcttccgcgtctcgtcttcatgaacgagaagttcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50207 - RNA, 293 nt, synthetic construct
  source 1..293: mol_type = other RNA
cgctcttccgcgtctcgtcttcatgaacgagaaggagttcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50208 - RNA, 293 nt, synthetic construct
  source 1..293: mol_type = other RNA
cgctcttccgcgtctcgtcttcatgaacgagaaggaggacttcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50209 - RNA, 293 nt, synthetic construct
  source 1..293: mol_type = other RNA
cgctcttccgcgtctcgtcttcatgaacgagaaggaggacatcttctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50210 - RNA, 293 nt, synthetic construct
  source 1..293: mol_type = other RNA
cgctcttccgcgtctcgtcttcatgaacgagaaggaggacatcctgttctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50211 - RNA, 293 nt, synthetic construct
  source 1..293: mol_type = other RNA
cgctcttccgcgtctcgtcttcatgaacgagaaggaggacatcctgtggttcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50212 - RNA, 293 nt, synthetic construct
  source 1..293: mol_type = other RNA
cgctcttccgcgtctcgtcttcatgaacgagaaggaggacatcctgtggtgcttcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50213 - RNA, 293 nt, synthetic construct
  source 1..293: mol_type = other RNA
cgctcttccgcgtctcgtcttcatgaacgagaaggaggacatcctgtggtgcactttcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50214 - RNA, 293 nt, synthetic construct
  source 1..293: mol_type = other RNA
cgctcttccgcgtctcgtcttcatgaacgagaaggaggacatcctgtggtgcactgaattcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50215 - RNA, 293 nt, synthetic construct
  source 1..293: mol_type = other RNA
cgctcttccgcgtctcgtcttcatgaacgagaaggaggacatcctgtggtgcactgaaatgttcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50216 - RNA, 293 nt, synthetic construct
  source 1..293: mol_type = other RNA
cgctcttccgcgtctcgtcttcatgaacgagaaggaggacatcctgtggtgcactgaaatggaattcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50217 - RNA, 293 nt, synthetic construct
  source 1..293: mol_type = other RNA
cgctcttccgcgtctcgtcttcatgaacgagaaggaggacatcctgtggtgcactgaaatggaaaggttctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50218 - RNA, 293 nt, synthetic construct
  source 1..293: mol_type = other RNA
cgctcttccgcgtctcgtcttcatgaacgagaaggaggacatcctgtggtgcactgaaatggaaagggtgttcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50219 - RNA, 293 nt, synthetic construct
  source 1..293: mol_type = other RNA
cgctcttccgcgtctcgtcttcatgaacgagaaggaggacatcctgtggtgcactgaaatggaaagggtgtttttcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50220 - RNA, 293 nt, synthetic construct; identical to SEQ ID NO: 49292
  source 1..293: mol_type = other RNA

SEQ ID NO: 50221 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcttcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50222 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccttccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50223 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcttctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50224 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacttcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50225 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacttcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50226 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacattcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50227 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacttctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50228 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgttcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50229 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccttcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50230 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacttcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50231 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgttccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50232 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcttcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50233 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50234 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgttcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50235 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgttccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50236 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggttcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50237 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagttcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50238 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagattcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50239 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgttcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50240 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgttccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50241 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcttctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50242 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggttctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50243 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgttcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50244 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggttcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50245 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcttcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50246 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgttcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50247 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgttcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50248 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcttccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50249 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcttccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50250 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcttcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50251 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacttcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50252 - RNA, 293 nt, synthetic construct; identical to SEQ ID NO: 49292
  source 1..293: mol_type = other RNA

SEQ ID NO: 50253 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcttcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50254 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctttcctgaaggaatattttgcttgtgtgtctagcggcaatagtaacgctaacagccgcgggccgagcttcagcagcggcctggtgccgttaagcttgcgcgagacgtcggaagagc

SEQ ID NO: 50255 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgttcaaggaatattttgcttgtgtgtctagcggcaatagtaacgctaacagccgcgggccgagcttcagcagcggcctggtgccgttaagcttgcgcgagacgtcggaagagc

SEQ ID NO: 50256 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgttcgaatattttgcttgtgtgtctagcggcaatagtaacgctaacagccgcgggccgagcttcagcagcggcctggtgccgttaagcttgcgcgagacgtcggaagagc

SEQ ID NO: 50257 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagttctattttgcttgtgtgtctagcggcaatagtaacgctaacagccgcgggccgagcttcagcagcggcctggtgccgttaagcttgcgcgagacgtcggaagagc

SEQ ID NO: 50258 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaattctttgcttgtgtgtctagcggcaatagtaacgctaacagccgcgggccgagcttcagcagcggcctggtgccgttaagcttgcgcgagacgtcggaagagc

SEQ ID NO: 50259 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttcgcttgtgtgtctagcggcaatagtaacgctaacagccgcgggccgagcttcagcagcggcctggtgccgttaagcttgcgcgagacgtcggaagagc

SEQ ID NO: 50260 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttttctgtgtgtctagcggcaatagtaacgctaacagccgcgggccgagcttcagcagcggcctggtgccgttaagcttgcgcgagacgtcggaagagc

SEQ ID NO: 50261 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctttcgtgtctagcggcaatagtaacgctaacagccgcgggccgagcttcagcagcggcctggtgccgttaagcttgcgcgagacgtcggaagagc

SEQ ID NO: 50262 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtttctctagcggcaatagtaacgctaacagccgcgggccgagcttcagcagcggcctggtgccgttaagcttgcgcgagacgtcggaagagc

SEQ ID NO: 50263 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgttcagcggcaatagtaacgctaacagccgcgggccgagcttcagcagcggcctggtgccgttaagcttgcgcgagacgtcggaagagc

SEQ ID NO: 50264 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctttcggcaatagtaacgctaacagccgcgggccgagcttcagcagcggcctggtgccgttaagcttgcgcgagacgtcggaagagc

SEQ ID NO: 50265 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcttcaatagtaacgctaacagccgcgggccgagcttcagcagcggcctggtgccgttaagcttgcgcgagacgtcggaagagc

SEQ ID NO: 50266 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcttcagtaacgctaacagccgcgggccgagcttcagcagcggcctggtgccgttaagcttgcgcgagacgtcggaagagc

SEQ ID NO: 50267 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatttcaacgctaacagccgcgggccgagcttcagcagcggcctggtgccgttaagcttgcgcgagacgtcggaagagc

SEQ ID NO: 50268 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtttcgctaacagccgcgggccgagcttcagcagcggcctggtgccgttaagcttgcgcgagacgtcggaagagc

SEQ ID NO: 50269 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacttcaacagccgcgggccgagcttcagcagcggcctggtgccgttaagcttgcgcgagacgtcggaagagc

SEQ ID NO: 50270 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctttcagccgcgggccgagcttcagcagcggcctggtgccgttaagcttgcgcgagacgtcggaagagc

SEQ ID NO: 50271 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacttccgcgggccgagcttcagcagcggcctggtgccgttaagcttgcgcgagacgtcggaagagc

SEQ ID NO: 50272 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcttcgggccgagcttcagcagcggcctggtgccgttaagcttgcgcgagacgtcggaagagc

SEQ ID NO: 50273 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcttcccgagcttcagcagcggcctggtgccgttaagcttgcgcgagacgtcggaagagc

SEQ ID NO: 50274 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggttcagcttcagcagcggcctggtgccgttaagcttgcgcgagacgtcggaagagc

SEQ ID NO: 50275 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgttcttcagcagcggcctggtgccgttaagcttgcgcgagacgtcggaagagc

SEQ ID NO: 50276 - RNA, 293 nt, synthetic construct; identical to SEQ ID NO: 49292
  source 1..293: mol_type = other RNA

SEQ ID NO: 50277 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcttcagcggcctggtgccgttaagcttgcgcgagacgtcggaagagc

SEQ ID NO: 50278 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcttcggcctggtgccgttaagcttgcgcgagacgtcggaagagc

SEQ ID NO: 50279 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcttcctggtgccgttaagcttgcgcgagacgtcggaagagc

SEQ ID NO: 50280 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcttcgtgccgttaagcttgcgcgagacgtcggaagagc

SEQ ID NO: 50281 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgttcccgttaagcttgcgcgagacgtcggaagagc

SEQ ID NO: 50282 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgttcttaagcttgcgcgagacgtcggaagagc

SEQ ID NO: 50283 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttcagcttgcgcgagacgtcggaagagc

SEQ ID NO: 50284 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttattcttgcgcgagacgtcggaagagc

SEQ ID NO: 50285 - RNA, 293 nt, synthetic construct
  source 1..293: mol_type = other RNA
cgctcttccgcgtctcgtcttctggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50286 - RNA, 293 nt, synthetic construct
  source 1..293: mol_type = other RNA
cgctcttccgcgtctcgtcttcatgtgggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50287 - RNA, 293 nt, synthetic construct
  source 1..293: mol_type = other RNA
cgctcttccgcgtctcgtcttcatgaactggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50288 - RNA, 293 nt, synthetic construct
  source 1..293: mol_type = other RNA
cgctcttccgcgtctcgtcttcatgaacgagtgggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50289 - RNA, 293 nt, synthetic construct
  source 1..293: mol_type = other RNA
cgctcttccgcgtctcgtcttcatgaacgagaagtgggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50290 - RNA, 293 nt, synthetic construct
  source 1..293: mol_type = other RNA
cgctcttccgcgtctcgtcttcatgaacgagaaggagtggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50291 - RNA, 293 nt, synthetic construct
  source 1..293: mol_type = other RNA
cgctcttccgcgtctcgtcttcatgaacgagaaggaggactggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50292 - RNA, 293 nt, synthetic construct
  source 1..293: mol_type = other RNA
cgctcttccgcgtctcgtcttcatgaacgagaaggaggacatctggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50293 - RNA, 293 nt, synthetic construct; identical to SEQ ID NO: 49292
  source 1..293: mol_type = other RNA

SEQ ID NO: 50294 - RNA, 293 nt, synthetic construct
  source 1..293: mol_type = other RNA
cgctcttccgcgtctcgtcttcatgaacgagaaggaggacatcctgtggtggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50295 - RNA, 293 nt, synthetic construct
  source 1..293: mol_type = other RNA
cgctcttccgcgtctcgtcttcatgaacgagaaggaggacatcctgtggtgctgggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50296 - RNA, 293 nt, synthetic construct
  source 1..293: mol_type = other RNA
cgctcttccgcgtctcgtcttcatgaacgagaaggaggacatcctgtggtgcacttggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50297 - RNA, 293 nt, synthetic construct
  source 1..293: mol_type = other RNA
cgctcttccgcgtctcgtcttcatgaacgagaaggaggacatcctgtggtgcactgaatgggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50298 - RNA, 293 nt, synthetic construct
  source 1..293: mol_type = other RNA
cgctcttccgcgtctcgtcttcatgaacgagaaggaggacatcctgtggtgcactgaaatgtggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50299 - RNA, 293 nt, synthetic construct
  source 1..293: mol_type = other RNA
cgctcttccgcgtctcgtcttcatgaacgagaaggaggacatcctgtggtgcactgaaatggaatgggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50300 - RNA, 293 nt, synthetic construct
  source 1..293: mol_type = other RNA
cgctcttccgcgtctcgtcttcatgaacgagaaggaggacatcctgtggtgcactgaaatggaaaggtggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50301 - RNA, 293 nt, synthetic construct
  source 1..293: mol_type = other RNA
cgctcttccgcgtctcgtcttcatgaacgagaaggaggacatcctgtggtgcactgaaatggaaagggtgtggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50302 - RNA, 293 nt, synthetic construct
  source 1..293: mol_type = other RNA
cgctcttccgcgtctcgtcttcatgaacgagaaggaggacatcctgtggtgcactgaaatggaaagggtgttttggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50303 - RNA, 293 nt, synthetic construct
  source 1..293: mol_type = other RNA
cgctcttccgcgtctcgtcttcatgaacgagaaggaggacatcctgtggtgcactgaaatggaaagggtgtttggctggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50304 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttctgggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50305 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccctggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50306 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtctggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50307 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50308 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactactgggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50309 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacatgggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50310 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagactggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50311 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50312 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcctggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50313 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaactggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50314 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgtggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50315 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagctggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50316 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgctgggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50317 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50318 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50319 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50320 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50321 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50322 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50323 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50324 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50325 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50326 - RNA, 293 nt, synthetic construct; identical to SEQ ID NO: 49292
  source 1..293: mol_type = other RNA

SEQ ID NO: 50327 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtgggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50328 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50329 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtgggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50330 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50331 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50332 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50333 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50334 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50335 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctgggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50336 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50337 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttggctgaaggaatattttgcttgtgtgtctagcggcaatagtaacgctaacagccgcgggccgagcttcagcagcggcctggtgccgttaagcttgcgcgagacgtcggaagagc

SEQ ID NO: 50338 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtggaaggaatattttgcttgtgtgtctagcggcaatagtaacgctaacagccgcgggccgagcttcagcagcggcctggtgccgttaagcttgcgcgagacgtcggaagagc

SEQ ID NO: 50339 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtgggaatattttgcttgtgtgtctagcggcaatagtaacgctaacagccgcgggccgagcttcagcagcggcctggtgccgttaagcttgcgcgagacgtcggaagagc

SEQ ID NO: 50340 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtggtattttgcttgtgtgtctagcggcaatagtaacgctaacagccgcgggccgagcttcagcagcggcctggtgccgttaagcttgcgcgagacgtcggaagagc

SEQ ID NO: 50341 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatggtttgcttgtgtgtctagcggcaatagtaacgctaacagccgcgggccgagcttcagcagcggcctggtgccgttaagcttgcgcgagacgtcggaagagc

SEQ ID NO: 50342 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattgggcttgtgtgtctagcggcaatagtaacgctaacagccgcgggccgagcttcagcagcggcctggtgccgttaagcttgcgcgagacgtcggaagagc

SEQ ID NO: 50343 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttggtgtgtgtctagcggcaatagtaacgctaacagccgcgggccgagcttcagcagcggcctggtgccgttaagcttgcgcgagacgtcggaagagc

SEQ ID NO: 50344 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgggtgtctagcggcaatagtaacgctaacagccgcgggccgagcttcagcagcggcctggtgccgttaagcttgcgcgagacgtcggaagagc

SEQ ID NO: 50345 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttggtctagcggcaatagtaacgctaacagccgcgggccgagcttcagcagcggcctggtgccgttaagcttgcgcgagacgtcggaagagc

SEQ ID NO: 50346 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtggagcggcaatagtaacgctaacagccgcgggccgagcttcagcagcggcctggtgccgttaagcttgcgcgagacgtcggaagagc

SEQ ID NO: 50347 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttggggcaatagtaacgctaacagccgcgggccgagcttcagcagcggcctggtgccgttaagcttgcgcgagacgtcggaagagc

SEQ ID NO: 50348 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctggaatagtaacgctaacagccgcgggccgagcttcagcagcggcctggtgccgttaagcttgcgcgagacgtcggaagagc

SEQ ID NO: 50349 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctggagtaacgctaacagccgcgggccgagcttcagcagcggcctggtgccgttaagcttgcgcgagacgtcggaagagc

SEQ ID NO: 50350 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattggaacgctaacagccgcgggccgagcttcagcagcggcctggtgccgttaagcttgcgcgagacgtcggaagagc

SEQ ID NO: 50351 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttgggctaacagccgcgggccgagcttcagcagcggcctggtgccgttaagcttgcgcgagacgtcggaagagc

SEQ ID NO: 50352 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactggaacagccgcgggccgagcttcagcagcggcctggtgccgttaagcttgcgcgagacgtcggaagagc

SEQ ID NO: 50353 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttggagccgcgggccgagcttcagcagcggcctggtgccgttaagcttgcgcgagacgtcggaagagc

SEQ ID NO: 50354 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactggcgcgggccgagcttcagcagcggcctggtgccgttaagcttgcgcgagacgtcggaagagc

SEQ ID NO: 50355 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctgggggccgagcttcagcagcggcctggtgccgttaagcttgcgcgagacgtcggaagagc

SEQ ID NO: 50356 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctggccgagcttcagcagcggcctggtgccgttaagcttgcgcgagacgtcggaagagc

SEQ ID NO: 50357 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtggagcttcagcagcggcctggtgccgttaagcttgcgcgagacgtcggaagagc

SEQ ID NO: 50358 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtggttcagcagcggcctggtgccgttaagcttgcgcgagacgtcggaagagc

SEQ ID NO: 50359 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctggagcagcggcctggtgccgttaagcttgcgcgagacgtcggaagagc

SEQ ID NO: 50360 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctggagcggcctggtgccgttaagcttgcgcgagacgtcggaagagc

SEQ ID NO: 50361 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctggggcctggtgccgttaagcttgcgcgagacgtcggaagagc

SEQ ID NO: 50362 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctggctggtgccgttaagcttgcgcgagacgtcggaagagc

SEQ ID NO: 50363 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctgggtgccgttaagcttgcgcgagacgtcggaagagc

SEQ ID NO: 50364 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtggccgttaagcttgcgcgagacgtcggaagagc

SEQ ID NO: 50365 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtggttaagcttgcgcgagacgtcggaagagc

SEQ ID NO: 50366 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtggagcttgcgcgagacgtcggaagagc

SEQ ID NO: 50367 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatggttgcgcgagacgtcggaagagc

SEQ ID NO: 50368 - RNA, 293 nt, synthetic construct
  source 1..293: mol_type = other RNA
cgctcttccgcgtctcgtcttctgcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50369 - RNA, 293 nt, synthetic construct
  source 1..293: mol_type = other RNA
cgctcttccgcgtctcgtcttcatgtgcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50370 - RNA, 293 nt, synthetic construct
  source 1..293: mol_type = other RNA
cgctcttccgcgtctcgtcttcatgaactgcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50371 - RNA, 293 nt, synthetic construct
  source 1..293: mol_type = other RNA
cgctcttccgcgtctcgtcttcatgaacgagtgcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50372 - RNA, 293 nt, synthetic construct
  source 1..293: mol_type = other RNA
cgctcttccgcgtctcgtcttcatgaacgagaagtgcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50373 - RNA, 293 nt, synthetic construct
  source 1..293: mol_type = other RNA
cgctcttccgcgtctcgtcttcatgaacgagaaggagtgcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50374 - RNA, 293 nt, synthetic construct
  source 1..293: mol_type = other RNA
cgctcttccgcgtctcgtcttcatgaacgagaaggaggactgcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50375 - RNA, 293 nt, synthetic construct
  source 1..293: mol_type = other RNA
cgctcttccgcgtctcgtcttcatgaacgagaaggaggacatctgctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50376 - RNA, 293 nt, synthetic construct
  source 1..293: mol_type = other RNA
cgctcttccgcgtctcgtcttcatgaacgagaaggaggacatcctgtgctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50377 - RNA, 293 nt, synthetic construct; identical to SEQ ID NO: 49292
  source 1..293: mol_type = other RNA

SEQ ID NO: 50378 - RNA, 293 nt, synthetic construct
  source 1..293: mol_type = other RNA
cgctcttccgcgtctcgtcttcatgaacgagaaggaggacatcctgtggtgctgcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50379 - RNA, 293 nt, synthetic construct
  source 1..293: mol_type = other RNA
cgctcttccgcgtctcgtcttcatgaacgagaaggaggacatcctgtggtgcacttgcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50380 - RNA, 293 nt, synthetic construct
  source 1..293: mol_type = other RNA
cgctcttccgcgtctcgtcttcatgaacgagaaggaggacatcctgtggtgcactgaatgcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50381 - RNA, 293 nt, synthetic construct
  source 1..293: mol_type = other RNA
cgctcttccgcgtctcgtcttcatgaacgagaaggaggacatcctgtggtgcactgaaatgtgcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50382 - RNA, 293 nt, synthetic construct
  source 1..293: mol_type = other RNA
cgctcttccgcgtctcgtcttcatgaacgagaaggaggacatcctgtggtgcactgaaatggaatgcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50383 - RNA, 293 nt, synthetic construct
  source 1..293: mol_type = other RNA
cgctcttccgcgtctcgtcttcatgaacgagaaggaggacatcctgtggtgcactgaaatggaaaggtgctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50384 - RNA, 293 nt, synthetic construct
  source 1..293: mol_type = other RNA
cgctcttccgcgtctcgtcttcatgaacgagaaggaggacatcctgtggtgcactgaaatggaaagggtgtgcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50385 - RNA, 293 nt, synthetic construct
  source 1..293: mol_type = other RNA
cgctcttccgcgtctcgtcttcatgaacgagaaggaggacatcctgtggtgcactgaaatggaaagggtgttttgcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50386 - RNA, 293 nt, synthetic construct
  source 1..293: mol_type = other RNA
cgctcttccgcgtctcgtcttcatgaacgagaaggaggacatcctgtggtgcactgaaatggaaagggtgtttggctgccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50387 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttctgcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50388 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccctgccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50389 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtctgctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50390 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactgcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50391 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactactgcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50392 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacatgcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50393 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagactgctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50394 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtgcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50395 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcctgcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50396 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaactgcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50397 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgtgccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50398 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagctgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50399 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgctgcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50400 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtgcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50401 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtgccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50402 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtgcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50403 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtgcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50404 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatgcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50405 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtgcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50406 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtgccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50407 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctgctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50408 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtgctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50409 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50410 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtgcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50411 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctgcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50412 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtgcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50413 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtgcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50414 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctgccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50415 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50416 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctgcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50417 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactgcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50418 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctgcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50419 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctgcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50420 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttgcctgaaggaatattttgcttgtgtgtctagcggcaatagtaacgctaacagccgcgggccgagcttcagcagcggcctggtgccgttaagcttgcgcgagacgtcggaagagc

SEQ ID NO: 50421 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtgcaaggaatattttgcttgtgtgtctagcggcaatagtaacgctaacagccgcgggccgagcttcagcagcggcctggtgccgttaagcttgcgcgagacgtcggaagagc

SEQ ID NO: 50422 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtgcgaatattttgcttgtgtgtctagcggcaatagtaacgctaacagccgcgggccgagcttcagcagcggcctggtgccgttaagcttgcgcgagacgtcggaagagc

SEQ ID NO: 50423 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtgctattttgcttgtgtgtctagcggcaatagtaacgctaacagccgcgggccgagcttcagcagcggcctggtgccgttaagcttgcgcgagacgtcggaagagc

SEQ ID NO: 50424 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatgctttgcttgtgtgtctagcggcaatagtaacgctaacagccgcgggccgagcttcagcagcggcctggtgccgttaagcttgcgcgagacgtcggaagagc

SEQ ID NO: 50425 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattgcgcttgtgtgtctagcggcaatagtaacgctaacagccgcgggccgagcttcagcagcggcctggtgccgttaagcttgcgcgagacgtcggaagagc

SEQ ID NO: 50426 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttgctgtgtgtctagcggcaatagtaacgctaacagccgcgggccgagcttcagcagcggcctggtgccgttaagcttgcgcgagacgtcggaagagc

SEQ ID NO: 50427 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgcgtgtctagcggcaatagtaacgctaacagccgcgggccgagcttcagcagcggcctggtgccgttaagcttgcgcgagacgtcggaagagc

SEQ ID NO: 50428 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttgctctagcggcaatagtaacgctaacagccgcgggccgagcttcagcagcggcctggtgccgttaagcttgcgcgagacgtcggaagagc

SEQ ID NO: 50429 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtgcagcggcaatagtaacgctaacagccgcgggccgagcttcagcagcggcctggtgccgttaagcttgcgcgagacgtcggaagagc

SEQ ID NO: 50430 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttgcggcaatagtaacgctaacagccgcgggccgagcttcagcagcggcctggtgccgttaagcttgcgcgagacgtcggaagagc

SEQ ID NO: 50431 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctgcaatagtaacgctaacagccgcgggccgagcttcagcagcggcctggtgccgttaagcttgcgcgagacgtcggaagagc

SEQ ID NO: 50432 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctgcagtaacgctaacagccgcgggccgagcttcagcagcggcctggtgccgttaagcttgcgcgagacgtcggaagagc

SEQ ID NO: 50433 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattgcaacgctaacagccgcgggccgagcttcagcagcggcctggtgccgttaagcttgcgcgagacgtcggaagagc

SEQ ID NO: 50434 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttgcgctaacagccgcgggccgagcttcagcagcggcctggtgccgttaagcttgcgcgagacgtcggaagagc

SEQ ID NO: 50435 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactgcaacagccgcgggccgagcttcagcagcggcctggtgccgttaagcttgcgcgagacgtcggaagagc

SEQ ID NO: 50436 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttgcagccgcgggccgagcttcagcagcggcctggtgccgttaagcttgcgcgagacgtcggaagagc

SEQ ID NO: 50437 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactgccgcgggccgagcttcagcagcggcctggtgccgttaagcttgcgcgagacgtcggaagagc

SEQ ID NO: 50438 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctgcgggccgagcttcagcagcggcctggtgccgttaagcttgcgcgagacgtcggaagagc

SEQ ID NO: 50439 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctgcccgagcttcagcagcggcctggtgccgttaagcttgcgcgagacgtcggaagagc

SEQ ID NO: 50440 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtgcagcttcagcagcggcctggtgccgttaagcttgcgcgagacgtcggaagagc

SEQ ID NO: 50441 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtgcttcagcagcggcctggtgccgttaagcttgcgcgagacgtcggaagagc

SEQ ID NO: 50442 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctgcagcagcggcctggtgccgttaagcttgcgcgagacgtcggaagagc

SEQ ID NO: 50443 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctgcagcggcctggtgccgttaagcttgcgcgagacgtcggaagagc

SEQ ID NO: 50444 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctgcggcctggtgccgttaagcttgcgcgagacgtcggaagagc

SEQ ID NO: 50445 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctgcctggtgccgttaagcttgcgcgagacgtcggaagagc

SEQ ID NO: 50446 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctgcgtgccgttaagcttgcgcgagacgtcggaagagc

SEQ ID NO: 50447 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtgcccgttaagcttgcgcgagacgtcggaagagc

SEQ ID NO: 50448 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtgcttaagcttgcgcgagacgtcggaagagc

SEQ ID NO: 50449 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtgcagcttgcgcgagacgtcggaagagc

SEQ ID NO: 50450 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatgcttgcgcgagacgtcggaagagc

SEQ ID NO: 50451 - RNA, 293 nt, synthetic construct
  source 1..293: mol_type = other RNA
cgctcttccgcgtctcgtcttctcgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50452 - RNA, 293 nt, synthetic construct
  source 1..293: mol_type = other RNA
cgctcttccgcgtctcgtcttcatgtcggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50453 - RNA, 293 nt, synthetic construct
  source 1..293: mol_type = other RNA
cgctcttccgcgtctcgtcttcatgaactcgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50454 - RNA, 293 nt, synthetic construct
  source 1..293: mol_type = other RNA
cgctcttccgcgtctcgtcttcatgaacgagtcggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50455 - RNA, 293 nt, synthetic construct
  source 1..293: mol_type = other RNA
cgctcttccgcgtctcgtcttcatgaacgagaagtcggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50456 - RNA, 293 nt, synthetic construct
  source 1..293: mol_type = other RNA
cgctcttccgcgtctcgtcttcatgaacgagaaggagtcgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50457 - RNA, 293 nt, synthetic construct
  source 1..293: mol_type = other RNA
cgctcttccgcgtctcgtcttcatgaacgagaaggaggactcgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50458 - RNA, 293 nt, synthetic construct
  source 1..293: mol_type = other RNA
cgctcttccgcgtctcgtcttcatgaacgagaaggaggacatctcgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50459 - RNA, 293 nt, synthetic construct
  source 1..293: mol_type = other RNA
cgctcttccgcgtctcgtcttcatgaacgagaaggaggacatcctgtcgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50460 - RNA, 293 nt, synthetic construct
  source 1..293: mol_type = other RNA
cgctcttccgcgtctcgtcttcatgaacgagaaggaggacatcctgtggtcgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50461 - RNA, 293 nt, synthetic construct
  source 1..293: mol_type = other RNA
cgctcttccgcgtctcgtcttcatgaacgagaaggaggacatcctgtggtgctcggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50462 - RNA, 293 nt, synthetic construct
  source 1..293: mol_type = other RNA
cgctcttccgcgtctcgtcttcatgaacgagaaggaggacatcctgtggtgcacttcgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50463 - RNA, 293 nt, synthetic construct
  source 1..293: mol_type = other RNA
cgctcttccgcgtctcgtcttcatgaacgagaaggaggacatcctgtggtgcactgaatcggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50464 - RNA, 293 nt, synthetic construct
  source 1..293: mol_type = other RNA
cgctcttccgcgtctcgtcttcatgaacgagaaggaggacatcctgtggtgcactgaaatgtcgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50465 - RNA, 293 nt, synthetic construct
  source 1..293: mol_type = other RNA
cgctcttccgcgtctcgtcttcatgaacgagaaggaggacatcctgtggtgcactgaaatggaatcggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50466 - RNA, 293 nt, synthetic construct
  source 1..293: mol_type = other RNA
cgctcttccgcgtctcgtcttcatgaacgagaaggaggacatcctgtggtgcactgaaatggaaaggtcgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50467 - RNA, 293 nt, synthetic construct
  source 1..293: mol_type = other RNA
cgctcttccgcgtctcgtcttcatgaacgagaaggaggacatcctgtggtgcactgaaatggaaagggtgtcgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50468 - RNA, 293 nt, synthetic construct
  source 1..293: mol_type = other RNA
cgctcttccgcgtctcgtcttcatgaacgagaaggaggacatcctgtggtgcactgaaatggaaagggtgttttcgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50469 - RNA, 293 nt, synthetic construct
  source 1..293: mol_type = other RNA
cgctcttccgcgtctcgtcttcatgaacgagaaggaggacatcctgtggtgcactgaaatggaaagggtgtttggctcgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50470 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttctcggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50471 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccctcgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50472 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtctcgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50473 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactcgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50474 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactactcggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50475 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacatcggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50476 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagactcgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50477 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50478 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcctcgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50479 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaactcgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50480 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgtcgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50481 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagctcgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50482 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgctcggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50483 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50484 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtcgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50485 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtcgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50486 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtcgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50487 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatcgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50488 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtcgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50489 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtcgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50490 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctcgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50491 - RNA, 293 nt, synthetic construct; identical to SEQ ID NO: 49292
  source 1..293: mol_type = other RNA

SEQ ID NO: 50492 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtcgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50493 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtcggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50494 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctcgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50495 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtcggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50496 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtcgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50497 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctcgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50498 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctcgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50499 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctcgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50500 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactcgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50501 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctcggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50502 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctcgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50503 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttcgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50504 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtcgaaggaatattttgcttgtgtgtctagcggcaatagtaacgctaacagccgcgggccgagcttcagcagcggcctggtgccgttaagcttgcgcgagacgtcggaagagc

SEQ ID NO: 50505 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtcggaatattttgcttgtgtgtctagcggcaatagtaacgctaacagccgcgggccgagcttcagcagcggcctggtgccgttaagcttgcgcgagacgtcggaagagc

SEQ ID NO: 50506 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtcgtattttgcttgtgtgtctagcggcaatagtaacgctaacagccgcgggccgagcttcagcagcggcctggtgccgttaagcttgcgcgagacgtcggaagagc

SEQ ID NO: 50507 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatcgtttgcttgtgtgtctagcggcaatagtaacgctaacagccgcgggccgagcttcagcagcggcctggtgccgttaagcttgcgcgagacgtcggaagagc

SEQ ID NO: 50508 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattcggcttgtgtgtctagcggcaatagtaacgctaacagccgcgggccgagcttcagcagcggcctggtgccgttaagcttgcgcgagacgtcggaagagc

SEQ ID NO: 50509 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttcgtgtgtgtctagcggcaatagtaacgctaacagccgcgggccgagcttcagcagcggcctggtgccgttaagcttgcgcgagacgtcggaagagc

SEQ ID NO: 50510 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttcggtgtctagcggcaatagtaacgctaacagccgcgggccgagcttcagcagcggcctggtgccgttaagcttgcgcgagacgtcggaagagc

SEQ ID NO: 50511 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttcgtctagcggcaatagtaacgctaacagccgcgggccgagcttcagcagcggcctggtgccgttaagcttgcgcgagacgtcggaagagc

SEQ ID NO: 50512 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcgagcggcaatagtaacgctaacagccgcgggccgagcttcagcagcggcctggtgccgttaagcttgcgcgagacgtcggaagagc

SEQ ID NO: 50513 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttcgggcaatagtaacgctaacagccgcgggccgagcttcagcagcggcctggtgccgttaagcttgcgcgagacgtcggaagagc

SEQ ID NO: 50514 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctcgaatagtaacgctaacagccgcgggccgagcttcagcagcggcctggtgccgttaagcttgcgcgagacgtcggaagagc

SEQ ID NO: 50515 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctcgagtaacgctaacagccgcgggccgagcttcagcagcggcctggtgccgttaagcttgcgcgagacgtcggaagagc

SEQ ID NO: 50516 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattcgaacgctaacagccgcgggccgagcttcagcagcggcctggtgccgttaagcttgcgcgagacgtcggaagagc

SEQ ID NO: 50517 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttcggctaacagccgcgggccgagcttcagcagcggcctggtgccgttaagcttgcgcgagacgtcggaagagc

SEQ ID NO: 50518 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactcgaacagccgcgggccgagcttcagcagcggcctggtgccgttaagcttgcgcgagacgtcggaagagc

SEQ ID NO: 50519 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttcgagccgcgggccgagcttcagcagcggcctggtgccgttaagcttgcgcgagacgtcggaagagc

SEQ ID NO: 50520 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactcgcgcgggccgagcttcagcagcggcctggtgccgttaagcttgcgcgagacgtcggaagagc

SEQ ID NO: 50521 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctcggggccgagcttcagcagcggcctggtgccgttaagcttgcgcgagacgtcggaagagc

SEQ ID NO: 50522 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctcgccgagcttcagcagcggcctggtgccgttaagcttgcgcgagacgtcggaagagc

SEQ ID NO: 50523 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtcgagcttcagcagcggcctggtgccgttaagcttgcgcgagacgtcggaagagc

SEQ ID NO: 50524 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtcgttcagcagcggcctggtgccgttaagcttgcgcgagacgtcggaagagc

SEQ ID NO: 50525 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctcgagcagcggcctggtgccgttaagcttgcgcgagacgtcggaagagc

SEQ ID NO: 50526 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctcgagcggcctggtgccgttaagcttgcgcgagacgtcggaagagc

SEQ ID NO: 50527 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctcgggcctggtgccgttaagcttgcgcgagacgtcggaagagc

SEQ ID NO: 50528 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctcgctggtgccgttaagcttgcgcgagacgtcggaagagc

SEQ ID NO: 50529 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctcggtgccgttaagcttgcgcgagacgtcggaagagc

SEQ ID NO: 50530 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtcgccgttaagcttgcgcgagacgtcggaagagc

SEQ ID NO: 50531 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtcgttaagcttgcgcgagacgtcggaagagc

SEQ ID NO: 50532 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtcgagcttgcgcgagacgtcggaagagc

SEQ ID NO: 50533 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatcgttgcgcgagacgtcggaagagc

SEQ ID NO: 50534 - RNA, 293 nt, synthetic construct
  source 1..293: mol_type = other RNA
cgctcttccgcgtctcgtcttctccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50535 - RNA, 293 nt, synthetic construct
  source 1..293: mol_type = other RNA
cgctcttccgcgtctcgtcttcatgtccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50536 - RNA, 293 nt, synthetic construct
  source 1..293: mol_type = other RNA
cgctcttccgcgtctcgtcttcatgaactccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50537 - RNA, 293 nt, synthetic construct
  source 1..293: mol_type = other RNA
cgctcttccgcgtctcgtcttcatgaacgagtccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50538 - RNA, 293 nt, synthetic construct
  source 1..293: mol_type = other RNA
cgctcttccgcgtctcgtcttcatgaacgagaagtccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50539 - RNA, 293 nt, synthetic construct
  source 1..293: mol_type = other RNA
cgctcttccgcgtctcgtcttcatgaacgagaaggagtccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50540 - RNA, 293 nt, synthetic construct
  source 1..293: mol_type = other RNA
cgctcttccgcgtctcgtcttcatgaacgagaaggaggactccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50541 - RNA, 293 nt, synthetic construct
  source 1..293: mol_type = other RNA
cgctcttccgcgtctcgtcttcatgaacgagaaggaggacatctcctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50542 - RNA, 293 nt, synthetic construct
  source 1..293: mol_type = other RNA
cgctcttccgcgtctcgtcttcatgaacgagaaggaggacatcctgtcctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50543 - RNA, 293 nt, synthetic construct
  source 1..293: mol_type = other RNA
cgctcttccgcgtctcgtcttcatgaacgagaaggaggacatcctgtggtccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50544 - RNA, 293 nt, synthetic construct
  source 1..293: mol_type = other RNA
cgctcttccgcgtctcgtcttcatgaacgagaaggaggacatcctgtggtgctccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50545 - RNA, 293 nt, synthetic construct
  source 1..293: mol_type = other RNA
cgctcttccgcgtctcgtcttcatgaacgagaaggaggacatcctgtggtgcacttccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50546 - RNA, 293 nt, synthetic construct
  source 1..293: mol_type = other RNA
cgctcttccgcgtctcgtcttcatgaacgagaaggaggacatcctgtggtgcactgaatccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50547 - RNA, 293 nt, synthetic construct
  source 1..293: mol_type = other RNA
cgctcttccgcgtctcgtcttcatgaacgagaaggaggacatcctgtggtgcactgaaatgtccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50548 - RNA, 293 nt, synthetic construct
  source 1..293: mol_type = other RNA
cgctcttccgcgtctcgtcttcatgaacgagaaggaggacatcctgtggtgcactgaaatggaatccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50549 - RNA, 293 nt, synthetic construct
  source 1..293: mol_type = other RNA
cgctcttccgcgtctcgtcttcatgaacgagaaggaggacatcctgtggtgcactgaaatggaaaggtcctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50550 - RNA, 293 nt, synthetic construct
  source 1..293: mol_type = other RNA
cgctcttccgcgtctcgtcttcatgaacgagaaggaggacatcctgtggtgcactgaaatggaaagggtgtccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50551 - RNA, 293 nt, synthetic construct
  source 1..293: mol_type = other RNA
cgctcttccgcgtctcgtcttcatgaacgagaaggaggacatcctgtggtgcactgaaatggaaagggtgttttccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50552 - RNA, 293 nt, synthetic construct
  source 1..293: mol_type = other RNA
cgctcttccgcgtctcgtcttcatgaacgagaaggaggacatcctgtggtgcactgaaatggaaagggtgtttggctcccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50553 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttctccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50554 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccctcccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50555 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtctcctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50556 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50557 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactactccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50558 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacatccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50559 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagactcctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50560 - RNA, 293 nt, synthetic construct; identical to SEQ ID NO: 49292
  source 1..293: mol_type = other RNA

SEQ ID NO: 50561 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcctccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50562 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaactccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50563 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgtcccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50564 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagctccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50565 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgctccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50566 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50567 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtcccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50568 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50569 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50570 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50571 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50572 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtcccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50573 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctcctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50574 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50575 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50576 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50577 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50578 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50579 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50580 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctcccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50581 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctcccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50582 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50583 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50584 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50585 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50586 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttccctgaaggaatattttgcttgtgtgtctagcggcaatagtaacgctaacagccgcgggccgagcttcagcagcggcctggtgccgttaagcttgcgcgagacgtcggaagagc

SEQ ID NO: 50587 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtccaaggaatattttgcttgtgtgtctagcggcaatagtaacgctaacagccgcgggccgagcttcagcagcggcctggtgccgttaagcttgcgcgagacgtcggaagagc

SEQ ID NO: 50588 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtccgaatattttgcttgtgtgtctagcggcaatagtaacgctaacagccgcgggccgagcttcagcagcggcctggtgccgttaagcttgcgcgagacgtcggaagagc

SEQ ID NO: 50589 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtcctattttgcttgtgtgtctagcggcaatagtaacgctaacagccgcgggccgagcttcagcagcggcctggtgccgttaagcttgcgcgagacgtcggaagagc

SEQ ID NO: 50590 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatcctttgcttgtgtgtctagcggcaatagtaacgctaacagccgcgggccgagcttcagcagcggcctggtgccgttaagcttgcgcgagacgtcggaagagc

SEQ ID NO: 50591 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattccgcttgtgtgtctagcggcaatagtaacgctaacagccgcgggccgagcttcagcagcggcctggtgccgttaagcttgcgcgagacgtcggaagagc

SEQ ID NO: 50592 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttcctgtgtgtctagcggcaatagtaacgctaacagccgcgggccgagcttcagcagcggcctggtgccgttaagcttgcgcgagacgtcggaagagc

SEQ ID NO: 50593 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttccgtgtctagcggcaatagtaacgctaacagccgcgggccgagcttcagcagcggcctggtgccgttaagcttgcgcgagacgtcggaagagc

SEQ ID NO: 50594 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttcctctagcggcaatagtaacgctaacagccgcgggccgagcttcagcagcggcctggtgccgttaagcttgcgcgagacgtcggaagagc

SEQ ID NO: 50595 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtccagcggcaatagtaacgctaacagccgcgggccgagcttcagcagcggcctggtgccgttaagcttgcgcgagacgtcggaagagc

SEQ ID NO: 50596 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttccggcaatagtaacgctaacagccgcgggccgagcttcagcagcggcctggtgccgttaagcttgcgcgagacgtcggaagagc

SEQ ID NO: 50597 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctccaatagtaacgctaacagccgcgggccgagcttcagcagcggcctggtgccgttaagcttgcgcgagacgtcggaagagc

SEQ ID NO: 50598 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctccagtaacgctaacagccgcgggccgagcttcagcagcggcctggtgccgttaagcttgcgcgagacgtcggaagagc

SEQ ID NO: 50599 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattccaacgctaacagccgcgggccgagcttcagcagcggcctggtgccgttaagcttgcgcgagacgtcggaagagc

SEQ ID NO: 50600 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttccgctaacagccgcgggccgagcttcagcagcggcctggtgccgttaagcttgcgcgagacgtcggaagagc

SEQ ID NO: 50601 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactccaacagccgcgggccgagcttcagcagcggcctggtgccgttaagcttgcgcgagacgtcggaagagc

SEQ ID NO: 50602 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttccagccgcgggccgagcttcagcagcggcctggtgccgttaagcttgcgcgagacgtcggaagagc

SEQ ID NO: 50603 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactcccgcgggccgagcttcagcagcggcctggtgccgttaagcttgcgcgagacgtcggaagagc

SEQ ID NO: 50604 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctccgggccgagcttcagcagcggcctggtgccgttaagcttgcgcgagacgtcggaagagc

SEQ ID NO: 50605 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctccccgagcttcagcagcggcctggtgccgttaagcttgcgcgagacgtcggaagagc

SEQ ID NO: 50606 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtccagcttcagcagcggcctggtgccgttaagcttgcgcgagacgtcggaagagc

SEQ ID NO: 50607 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtccttcagcagcggcctggtgccgttaagcttgcgcgagacgtcggaagagc

SEQ ID NO: 50608 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctccagcagcggcctggtgccgttaagcttgcgcgagacgtcggaagagc

SEQ ID NO: 50609 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctccagcggcctggtgccgttaagcttgcgcgagacgtcggaagagc

SEQ ID NO: 50610 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctccggcctggtgccgttaagcttgcgcgagacgtcggaagagc

SEQ ID NO: 50611 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctccctggtgccgttaagcttgcgcgagacgtcggaagagc

SEQ ID NO: 50612 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctccgtgccgttaagcttgcgcgagacgtcggaagagc

SEQ ID NO: 50613 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtccccgttaagcttgcgcgagacgtcggaagagc

SEQ ID NO: 50614 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtccttaagcttgcgcgagacgtcggaagagc

SEQ ID NO: 50615 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtccagcttgcgcgagacgtcggaagagc

SEQ ID NO: 50616 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatccttgcgcgagacgtcggaagagc

SEQ ID NO: 50617 - RNA, 293 nt, synthetic construct
  source 1..293: mol_type = other RNA
cgctcttccgcgtctcgtcttcgagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50618 - RNA, 293 nt, synthetic construct
  source 1..293: mol_type = other RNA
cgctcttccgcgtctcgtcttcatggaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50619 - RNA, 293 nt, synthetic construct; identical to SEQ ID NO: 49292
  source 1..293: mol_type = other RNA

SEQ ID NO: 50620 - RNA, 293 nt, synthetic construct
  source 1..293: mol_type = other RNA
cgctcttccgcgtctcgtcttcatgaacgaggaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50621 - RNA, 293 nt, synthetic construct; identical to SEQ ID NO: 49292
  source 1..293: mol_type = other RNA

SEQ ID NO: 50622 - RNA, 293 nt, synthetic construct
  source 1..293: mol_type = other RNA
cgctcttccgcgtctcgtcttcatgaacgagaaggaggagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50623 - RNA, 293 nt, synthetic construct
  source 1..293: mol_type = other RNA
cgctcttccgcgtctcgtcttcatgaacgagaaggaggacgagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50624 - RNA, 293 nt, synthetic construct
  source 1..293: mol_type = other RNA
cgctcttccgcgtctcgtcttcatgaacgagaaggaggacatcgagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50625 - RNA, 293 nt, synthetic construct
  source 1..293: mol_type = other RNA
cgctcttccgcgtctcgtcttcatgaacgagaaggaggacatcctggagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50626 - RNA, 293 nt, synthetic construct
  source 1..293: mol_type = other RNA
cgctcttccgcgtctcgtcttcatgaacgagaaggaggacatcctgtgggagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50627 - RNA, 293 nt, synthetic construct
  source 1..293: mol_type = other RNA
cgctcttccgcgtctcgtcttcatgaacgagaaggaggacatcctgtggtgcgaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50628 - RNA, 293 nt, synthetic construct
  source 1..293: mol_type = other RNA
cgctcttccgcgtctcgtcttcatgaacgagaaggaggacatcctgtggtgcactgagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50629 - RNA, 293 nt, synthetic construct
  source 1..293: mol_type = other RNA
cgctcttccgcgtctcgtcttcatgaacgagaaggaggacatcctgtggtgcactgaagaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50630 - RNA, 293 nt, synthetic construct
  source 1..293: mol_type = other RNA
cgctcttccgcgtctcgtcttcatgaacgagaaggaggacatcctgtggtgcactgaaatggagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50631 - RNA, 293 nt, synthetic construct
  source 1..293: mol_type = other RNA
cgctcttccgcgtctcgtcttcatgaacgagaaggaggacatcctgtggtgcactgaaatggaagaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50632 - RNA, 293 nt, synthetic construct
  source 1..293: mol_type = other RNA
cgctcttccgcgtctcgtcttcatgaacgagaaggaggacatcctgtggtgcactgaaatggaaagggagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50633 - RNA, 293 nt, synthetic construct
  source 1..293: mol_type = other RNA
cgctcttccgcgtctcgtcttcatgaacgagaaggaggacatcctgtggtgcactgaaatggaaagggtggagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50634 - RNA, 293 nt, synthetic construct
  source 1..293: mol_type = other RNA
cgctcttccgcgtctcgtcttcatgaacgagaaggaggacatcctgtggtgcactgaaatggaaagggtgtttgagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50635 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50636 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcgaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50637 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50638 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50639 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50640 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacgaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50641 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50642 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50643 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50644 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50645 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50646 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50647 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50648 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50649 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50650 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50651 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50652 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50653 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50654 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50655 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50656 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50657 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50658 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50659 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50660 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50661 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50662 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50663 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50664 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50665 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50666 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50667 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50668 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50669 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgagctgaaggaatattttgcttgtgtgtctagcggcaatagtaacgctaacagccgcgggccgagcttcagcagcggcctggtgccgttaagcttgcgcgagacgtcggaagagc

SEQ ID NO: 50670 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggagaaggaatattttgcttgtgtgtctagcggcaatagtaacgctaacagccgcgggccgagcttcagcagcggcctggtgccgttaagcttgcgcgagacgtcggaagagc

SEQ ID NO: 50671 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggaggaatattttgcttgtgtgtctagcggcaatagtaacgctaacagccgcgggccgagcttcagcagcggcctggtgccgttaagcttgcgcgagacgtcggaagagc

SEQ ID NO: 50672 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggagtattttgcttgtgtgtctagcggcaatagtaacgctaacagccgcgggccgagcttcagcagcggcctggtgccgttaagcttgcgcgagacgtcggaagagc

SEQ ID NO: 50673 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagagtttgcttgtgtgtctagcggcaatagtaacgctaacagccgcgggccgagcttcagcagcggcctggtgccgttaagcttgcgcgagacgtcggaagagc

SEQ ID NO: 50674 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgaggcttgtgtgtctagcggcaatagtaacgctaacagccgcgggccgagcttcagcagcggcctggtgccgttaagcttgcgcgagacgtcggaagagc

SEQ ID NO: 50675 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgagtgtgtgtctagcggcaatagtaacgctaacagccgcgggccgagcttcagcagcggcctggtgccgttaagcttgcgcgagacgtcggaagagc

SEQ ID NO: 50676 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgaggtgtctagcggcaatagtaacgctaacagccgcgggccgagcttcagcagcggcctggtgccgttaagcttgcgcgagacgtcggaagagc

SEQ ID NO: 50677 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgagtctagcggcaatagtaacgctaacagccgcgggccgagcttcagcagcggcctggtgccgttaagcttgcgcgagacgtcggaagagc

SEQ ID NO: 50678 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggagagcggcaatagtaacgctaacagccgcgggccgagcttcagcagcggcctggtgccgttaagcttgcgcgagacgtcggaagagc

SEQ ID NO: 50679 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgagggcaatagtaacgctaacagccgcgggccgagcttcagcagcggcctggtgccgttaagcttgcgcgagacgtcggaagagc

SEQ ID NO: 50680 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgagaatagtaacgctaacagccgcgggccgagcttcagcagcggcctggtgccgttaagcttgcgcgagacgtcggaagagc

SEQ ID NO: 50681 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgagagtaacgctaacagccgcgggccgagcttcagcagcggcctggtgccgttaagcttgcgcgagacgtcggaagagc

SEQ ID NO: 50682 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgagaacgctaacagccgcgggccgagcttcagcagcggcctggtgccgttaagcttgcgcgagacgtcggaagagc

SEQ ID NO: 50683 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgaggctaacagccgcgggccgagcttcagcagcggcctggtgccgttaagcttgcgcgagacgtcggaagagc

SEQ ID NO: 50684 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgagaacagccgcgggccgagcttcagcagcggcctggtgccgttaagcttgcgcgagacgtcggaagagc

SEQ ID NO: 50685 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgagagccgcgggccgagcttcagcagcggcctggtgccgttaagcttgcgcgagacgtcggaagagc

SEQ ID NO: 50686 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgagcgcgggccgagcttcagcagcggcctggtgccgttaagcttgcgcgagacgtcggaagagc

SEQ ID NO: 50687 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgaggggccgagcttcagcagcggcctggtgccgttaagcttgcgcgagacgtcggaagagc

SEQ ID NO: 50688 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgagccgagcttcagcagcggcctggtgccgttaagcttgcgcgagacgtcggaagagc

SEQ ID NO: 50689 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggagagcttcagcagcggcctggtgccgttaagcttgcgcgagacgtcggaagagc

SEQ ID NO: 50690 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggagttcagcagcggcctggtgccgttaagcttgcgcgagacgtcggaagagc

SEQ ID NO: 50691 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgagagcagcggcctggtgccgttaagcttgcgcgagacgtcggaagagc

SEQ ID NO: 50692 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgagagcggcctggtgccgttaagcttgcgcgagacgtcggaagagc

SEQ ID NO: 50693 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgagggcctggtgccgttaagcttgcgcgagacgtcggaagagc

SEQ ID NO: 50694 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgagctggtgccgttaagcttgcgcgagacgtcggaagagc

SEQ ID NO: 50695 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgaggtgccgttaagcttgcgcgagacgtcggaagagc

SEQ ID NO: 50696 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggagccgttaagcttgcgcgagacgtcggaagagc

SEQ ID NO: 50697 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggagttaagcttgcgcgagacgtcggaagagc

SEQ ID NO: 50698 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggagagcttgcgcgagacgtcggaagagc

SEQ ID NO: 50699 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagagttgcgcgagacgtcggaagagc

SEQ ID NO: 50700 - RNA, 293 nt, synthetic construct
  source 1..293: mol_type = other RNA
cgctcttccgcgtctcgtcttcgacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50701 - RNA, 293 nt, synthetic construct
  source 1..293: mol_type = other RNA
cgctcttccgcgtctcgtcttcatggacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50702 - RNA, 293 nt, synthetic construct
  source 1..293: mol_type = other RNA
cgctcttccgcgtctcgtcttcatgaacgacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50703 - RNA, 293 nt, synthetic construct
  source 1..293: mol_type = other RNA
cgctcttccgcgtctcgtcttcatgaacgaggacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50704 - RNA, 293 nt, synthetic construct
  source 1..293: mol_type = other RNA
cgctcttccgcgtctcgtcttcatgaacgagaaggacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50705 - RNA, 293 nt, synthetic construct; identical to SEQ ID NO: 49292
  source 1..293: mol_type = other RNA

SEQ ID NO: 50706 - RNA, 293 nt, synthetic construct
  source 1..293: mol_type = other RNA
cgctcttccgcgtctcgtcttcatgaacgagaaggaggacgacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50707 - RNA, 293 nt, synthetic construct
  source 1..293: mol_type = other RNA
cgctcttccgcgtctcgtcttcatgaacgagaaggaggacatcgactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50708 - RNA, 293 nt, synthetic construct
  source 1..293: mol_type = other RNA
cgctcttccgcgtctcgtcttcatgaacgagaaggaggacatcctggactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50709 - RNA, 293 nt, synthetic construct
  source 1..293: mol_type = other RNA
cgctcttccgcgtctcgtcttcatgaacgagaaggaggacatcctgtgggacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50710 - RNA, 293 nt, synthetic construct
  source 1..293: mol_type = other RNA
cgctcttccgcgtctcgtcttcatgaacgagaaggaggacatcctgtggtgcgacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50711 - RNA, 293 nt, synthetic construct
  source 1..293: mol_type = other RNA
cgctcttccgcgtctcgtcttcatgaacgagaaggaggacatcctgtggtgcactgacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50712 - RNA, 293 nt, synthetic construct
  source 1..293: mol_type = other RNA
cgctcttccgcgtctcgtcttcatgaacgagaaggaggacatcctgtggtgcactgaagacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50713 - RNA, 293 nt, synthetic construct
  source 1..293: mol_type = other RNA
cgctcttccgcgtctcgtcttcatgaacgagaaggaggacatcctgtggtgcactgaaatggacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50714 - RNA, 293 nt, synthetic construct
  source 1..293: mol_type = other RNA
cgctcttccgcgtctcgtcttcatgaacgagaaggaggacatcctgtggtgcactgaaatggaagacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50715 - RNA, 293 nt, synthetic construct
  source 1..293: mol_type = other RNA
cgctcttccgcgtctcgtcttcatgaacgagaaggaggacatcctgtggtgcactgaaatggaaagggactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50716 - RNA, 293 nt, synthetic construct
  source 1..293: mol_type = other RNA
cgctcttccgcgtctcgtcttcatgaacgagaaggaggacatcctgtggtgcactgaaatggaaagggtggacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50717 - RNA, 293 nt, synthetic construct
  source 1..293: mol_type = other RNA
cgctcttccgcgtctcgtcttcatgaacgagaaggaggacatcctgtggtgcactgaaatggaaagggtgtttgacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50718 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50719 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcgacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50720 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50721 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50722 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50723 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacgacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50724 - RNA, 293 nt, synthetic construct; identical to SEQ ID NO: 49292
  source 1..293: mol_type = other RNA

SEQ ID NO: 50725 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50726 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50727 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50728 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50729 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50730 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50731 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50732 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50733 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50734 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50735 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50736 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50737 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50738 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50739 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50740 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50741 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50742 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50743 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50744 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50745 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50746 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50747 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50748 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50749 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50750 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50751 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50752 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgacctgaaggaatattttgcttgtgtgtctagcggcaatagtaacgctaacagccgcgggccgagcttcagcagcggcctggtgccgttaagcttgcgcgagacgtcggaagagc

SEQ ID NO: 50753 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggacaaggaatattttgcttgtgtgtctagcggcaatagtaacgctaacagccgcgggccgagcttcagcagcggcctggtgccgttaagcttgcgcgagacgtcggaagagc

SEQ ID NO: 50754 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggacgaatattttgcttgtgtgtctagcggcaatagtaacgctaacagccgcgggccgagcttcagcagcggcctggtgccgttaagcttgcgcgagacgtcggaagagc

SEQ ID NO: 50755 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggactattttgcttgtgtgtctagcggcaatagtaacgctaacagccgcgggccgagcttcagcagcggcctggtgccgttaagcttgcgcgagacgtcggaagagc

SEQ ID NO: 50756 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagactttgcttgtgtgtctagcggcaatagtaacgctaacagccgcgggccgagcttcagcagcggcctggtgccgttaagcttgcgcgagacgtcggaagagc

SEQ ID NO: 50757 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgacgcttgtgtgtctagcggcaatagtaacgctaacagccgcgggccgagcttcagcagcggcctggtgccgttaagcttgcgcgagacgtcggaagagc

SEQ ID NO: 50758 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgactgtgtgtctagcggcaatagtaacgctaacagccgcgggccgagcttcagcagcggcctggtgccgttaagcttgcgcgagacgtcggaagagc

SEQ ID NO: 50759 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgacgtgtctagcggcaatagtaacgctaacagccgcgggccgagcttcagcagcggcctggtgccgttaagcttgcgcgagacgtcggaagagc

SEQ ID NO: 50760 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgactctagcggcaatagtaacgctaacagccgcgggccgagcttcagcagcggcctggtgccgttaagcttgcgcgagacgtcggaagagc

SEQ ID NO: 50761 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggacagcggcaatagtaacgctaacagccgcgggccgagcttcagcagcggcctggtgccgttaagcttgcgcgagacgtcggaagagc

SEQ ID NO: 50762 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgacggcaatagtaacgctaacagccgcgggccgagcttcagcagcggcctggtgccgttaagcttgcgcgagacgtcggaagagc

SEQ ID NO: 50763 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgacaatagtaacgctaacagccgcgggccgagcttcagcagcggcctggtgccgttaagcttgcgcgagacgtcggaagagc

SEQ ID NO: 50764 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgacagtaacgctaacagccgcgggccgagcttcagcagcggcctggtgccgttaagcttgcgcgagacgtcggaagagc

SEQ ID NO: 50765 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgacaacgctaacagccgcgggccgagcttcagcagcggcctggtgccgttaagcttgcgcgagacgtcggaagagc

SEQ ID NO: 50766 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgacgctaacagccgcgggccgagcttcagcagcggcctggtgccgttaagcttgcgcgagacgtcggaagagc

SEQ ID NO: 50767 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgacaacagccgcgggccgagcttcagcagcggcctggtgccgttaagcttgcgcgagacgtcggaagagc

SEQ ID NO: 50768 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgacagccgcgggccgagcttcagcagcggcctggtgccgttaagcttgcgcgagacgtcggaagagc

SEQ ID NO: 50769 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgaccgcgggccgagcttcagcagcggcctggtgccgttaagcttgcgcgagacgtcggaagagc

SEQ ID NO: 50770 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgacgggccgagcttcagcagcggcctggtgccgttaagcttgcgcgagacgtcggaagagc

SEQ ID NO: 50771 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgacccgagcttcagcagcggcctggtgccgttaagcttgcgcgagacgtcggaagagc

SEQ ID NO: 50772 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggacagcttcagcagcggcctggtgccgttaagcttgcgcgagacgtcggaagagc

SEQ ID NO: 50773 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggacttcagcagcggcctggtgccgttaagcttgcgcgagacgtcggaagagc

SEQ ID NO: 50774 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgacagcagcggcctggtgccgttaagcttgcgcgagacgtcggaagagc

SEQ ID NO: 50775 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgacagcggcctggtgccgttaagcttgcgcgagacgtcggaagagc

SEQ ID NO: 50776 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgacggcctggtgccgttaagcttgcgcgagacgtcggaagagc

SEQ ID NO: 50777 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgacctggtgccgttaagcttgcgcgagacgtcggaagagc

SEQ ID NO: 50778 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgacgtgccgttaagcttgcgcgagacgtcggaagagc

SEQ ID NO: 50779 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggacccgttaagcttgcgcgagacgtcggaagagc

SEQ ID NO: 50780 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggacttaagcttgcgcgagacgtcggaagagc

SEQ ID NO: 50781 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggacagcttgcgcgagacgtcggaagagc

SEQ ID NO: 50782 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagacttgcgcgagacgtcggaagagc

SEQ ID NO: 50783 - RNA, 293 nt, synthetic construct
  source 1..293: mol_type = other RNA
cgctcttccgcgtctcgtcttcgtgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50784 - RNA, 293 nt, synthetic construct
  source 1..293: mol_type = other RNA
cgctcttccgcgtctcgtcttcatggtggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50785 - RNA, 293 nt, synthetic construct
  source 1..293: mol_type = other RNA
cgctcttccgcgtctcgtcttcatgaacgtgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50786 - RNA, 293 nt, synthetic construct
  source 1..293: mol_type = other RNA
cgctcttccgcgtctcgtcttcatgaacgaggtggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50787 - RNA, 293 nt, synthetic construct
  source 1..293: mol_type = other RNA
cgctcttccgcgtctcgtcttcatgaacgagaaggtggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50788 - RNA, 293 nt, synthetic construct
  source 1..293: mol_type = other RNA
cgctcttccgcgtctcgtcttcatgaacgagaaggaggtgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50789 - RNA, 293 nt, synthetic construct
  source 1..293: mol_type = other RNA
cgctcttccgcgtctcgtcttcatgaacgagaaggaggacgtgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50790 - RNA, 293 nt, synthetic construct
  source 1..293: mol_type = other RNA
cgctcttccgcgtctcgtcttcatgaacgagaaggaggacatcgtgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50791 - RNA, 293 nt, synthetic construct
  source 1..293: mol_type = other RNA
cgctcttccgcgtctcgtcttcatgaacgagaaggaggacatcctggtgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50792 - RNA, 293 nt, synthetic construct
  source 1..293: mol_type = other RNA
cgctcttccgcgtctcgtcttcatgaacgagaaggaggacatcctgtgggtgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50793 - RNA, 293 nt, synthetic construct
  source 1..293: mol_type = other RNA
cgctcttccgcgtctcgtcttcatgaacgagaaggaggacatcctgtggtgcgtggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50794 - RNA, 293 nt, synthetic construct
  source 1..293: mol_type = other RNA
cgctcttccgcgtctcgtcttcatgaacgagaaggaggacatcctgtggtgcactgtgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50795 - RNA, 293 nt, synthetic construct
  source 1..293: mol_type = other RNA
cgctcttccgcgtctcgtcttcatgaacgagaaggaggacatcctgtggtgcactgaagtggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50796 - RNA, 293 nt, synthetic construct
  source 1..293: mol_type = other RNA
cgctcttccgcgtctcgtcttcatgaacgagaaggaggacatcctgtggtgcactgaaatggtgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50797 - RNA, 293 nt, synthetic construct
  source 1..293: mol_type = other RNA
cgctcttccgcgtctcgtcttcatgaacgagaaggaggacatcctgtggtgcactgaaatggaagtggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50798 - RNA, 293 nt, synthetic construct; identical to SEQ ID NO: 49292
  source 1..293: mol_type = other RNA

SEQ ID NO: 50799 - RNA, 293 nt, synthetic construct
  source 1..293: mol_type = other RNA
cgctcttccgcgtctcgtcttcatgaacgagaaggaggacatcctgtggtgcactgaaatggaaagggtggtgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50800 - RNA, 293 nt, synthetic construct
  source 1..293: mol_type = other RNA
cgctcttccgcgtctcgtcttcatgaacgagaaggaggacatcctgtggtgcactgaaatggaaagggtgtttgtgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50801 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgtgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50802 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcgtggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50803 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50804 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgtgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50805 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgtgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50806 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacgtggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50807 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagtggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50808 - RNA, 293 nt, synthetic construct; identical to SEQ ID NO: 49292
  source 1..293: mol_type = other RNA

SEQ ID NO: 50809 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggtgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50810 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgtgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50811 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgtgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50812 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggtgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50813 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgtgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50814 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgtggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50815 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggtgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50816 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggtgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50817 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggtgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50818 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggtgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50819 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagtgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50820 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggtgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50821 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggtgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50822 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgtgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50823 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggtgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50824 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggtgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50825 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggtggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50826 - RNA, 293 nt, synthetic construct; identical to SEQ ID NO: 49292
  source 1..293: mol_type = other RNA

SEQ ID NO: 50827 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggtggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50828 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50829 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgtgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50830 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgtgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50831 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgtgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50832 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgtgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50833 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgtggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50834 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgtgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50835 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgtgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50836 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggtgaaggaatattttgcttgtgtgtctagcggcaatagtaacgctaacagccgcgggccgagcttcagcagcggcctggtgccgttaagcttgcgcgagacgtcggaagagc

SEQ ID NO: 50837 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggtggaatattttgcttgtgtgtctagcggcaatagtaacgctaacagccgcgggccgagcttcagcagcggcctggtgccgttaagcttgcgcgagacgtcggaagagc

SEQ ID NO: 50838 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggtgtattttgcttgtgtgtctagcggcaatagtaacgctaacagccgcgggccgagcttcagcagcggcctggtgccgttaagcttgcgcgagacgtcggaagagc

SEQ ID NO: 50839 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagtgtttgcttgtgtgtctagcggcaatagtaacgctaacagccgcgggccgagcttcagcagcggcctggtgccgttaagcttgcgcgagacgtcggaagagc

SEQ ID NO: 50840 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgtggcttgtgtgtctagcggcaatagtaacgctaacagccgcgggccgagcttcagcagcggcctggtgccgttaagcttgcgcgagacgtcggaagagc

SEQ ID NO: 50841 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgtgtgtgtgtctagcggcaatagtaacgctaacagccgcgggccgagcttcagcagcggcctggtgccgttaagcttgcgcgagacgtcggaagagc

SEQ ID NO: 50842 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgtggtgtctagcggcaatagtaacgctaacagccgcgggccgagcttcagcagcggcctggtgccgttaagcttgcgcgagacgtcggaagagc

SEQ ID NO: 50843 - RNA, 293 nt, synthetic construct; identical to SEQ ID NO: 49292
  source 1..293: mol_type = other RNA

SEQ ID NO: 50844 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggtgagcggcaatagtaacgctaacagccgcgggccgagcttcagcagcggcctggtgccgttaagcttgcgcgagacgtcggaagagc

SEQ ID NO: 50845 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgtgggcaatagtaacgctaacagccgcgggccgagcttcagcagcggcctggtgccgttaagcttgcgcgagacgtcggaagagc

SEQ ID NO: 50846 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgtgaatagtaacgctaacagccgcgggccgagcttcagcagcggcctggtgccgttaagcttgcgcgagacgtcggaagagc

SEQ ID NO: 50847 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgtgagtaacgctaacagccgcgggccgagcttcagcagcggcctggtgccgttaagcttgcgcgagacgtcggaagagc

SEQ ID NO: 50848 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgtgaacgctaacagccgcgggccgagcttcagcagcggcctggtgccgttaagcttgcgcgagacgtcggaagagc

SEQ ID NO: 50849 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgtggctaacagccgcgggccgagcttcagcagcggcctggtgccgttaagcttgcgcgagacgtcggaagagc

SEQ ID NO: 50850 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgtgaacagccgcgggccgagcttcagcagcggcctggtgccgttaagcttgcgcgagacgtcggaagagc

SEQ ID NO: 50851 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgtgagccgcgggccgagcttcagcagcggcctggtgccgttaagcttgcgcgagacgtcggaagagc

SEQ ID NO: 50852 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgtgcgcgggccgagcttcagcagcggcctggtgccgttaagcttgcgcgagacgtcggaagagc

SEQ ID NO: 50853 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgtggggccgagcttcagcagcggcctggtgccgttaagcttgcgcgagacgtcggaagagc

SEQ ID NO: 50854 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgtgccgagcttcagcagcggcctggtgccgttaagcttgcgcgagacgtcggaagagc

SEQ ID NO: 50855 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggtgagcttcagcagcggcctggtgccgttaagcttgcgcgagacgtcggaagagc

SEQ ID NO: 50856 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggtgttcagcagcggcctggtgccgttaagcttgcgcgagacgtcggaagagc

SEQ ID NO: 50857 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgtgagcagcggcctggtgccgttaagcttgcgcgagacgtcggaagagc

SEQ ID NO: 50858 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgtgagcggcctggtgccgttaagcttgcgcgagacgtcggaagagc

SEQ ID NO: 50859 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgtgggcctggtgccgttaagcttgcgcgagacgtcggaagagc

SEQ ID NO: 50860 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgtgctggtgccgttaagcttgcgcgagacgtcggaagagc

SEQ ID NO: 50861 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgtggtgccgttaagcttgcgcgagacgtcggaagagc

SEQ ID NO: 50862 - RNA, 293 nt, synthetic construct; identical to SEQ ID NO: 49292
  source 1..293: mol_type = other RNA

SEQ ID NO: 50863 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggtgttaagcttgcgcgagacgtcggaagagc

SEQ ID NO: 50864 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggtgagcttgcgcgagacgtcggaagagc

SEQ ID NO: 50865 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagtgttgcgcgagacgtcggaagagc

SEQ ID NO: 50866 - RNA, 293 nt, synthetic construct
  source 1..293: mol_type = other RNA
cgctcttccgcgtctcgtcttcgtcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50867 - RNA, 293 nt, synthetic construct
  source 1..293: mol_type = other RNA
cgctcttccgcgtctcgtcttcatggtcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50868 - RNA, 293 nt, synthetic construct
  source 1..293: mol_type = other RNA
cgctcttccgcgtctcgtcttcatgaacgtcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50869 - RNA, 293 nt, synthetic construct
  source 1..293: mol_type = other RNA
cgctcttccgcgtctcgtcttcatgaacgaggtcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50870 - RNA, 293 nt, synthetic construct
  source 1..293: mol_type = other RNA
cgctcttccgcgtctcgtcttcatgaacgagaaggtcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50871 - RNA, 293 nt, synthetic construct
  source 1..293: mol_type = other RNA
cgctcttccgcgtctcgtcttcatgaacgagaaggaggtcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50872 - RNA, 293 nt, synthetic construct
  source 1..293: mol_type = other RNA
cgctcttccgcgtctcgtcttcatgaacgagaaggaggacgtcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50873 - RNA, 293 nt, synthetic construct
  source 1..293: mol_type = other RNA
cgctcttccgcgtctcgtcttcatgaacgagaaggaggacatcgtctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50874 - RNA, 293 nt, synthetic construct
  source 1..293: mol_type = other RNA
cgctcttccgcgtctcgtcttcatgaacgagaaggaggacatcctggtctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50875 - RNA, 293 nt, synthetic construct
  source 1..293: mol_type = other RNA
cgctcttccgcgtctcgtcttcatgaacgagaaggaggacatcctgtgggtcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50876 - RNA, 293 nt, synthetic construct
  source 1..293: mol_type = other RNA
cgctcttccgcgtctcgtcttcatgaacgagaaggaggacatcctgtggtgcgtcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50877 - RNA, 293 nt, synthetic construct
  source 1..293: mol_type = other RNA
cgctcttccgcgtctcgtcttcatgaacgagaaggaggacatcctgtggtgcactgtcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50878 - RNA, 293 nt, synthetic construct
  source 1..293: mol_type = other RNA
cgctcttccgcgtctcgtcttcatgaacgagaaggaggacatcctgtggtgcactgaagtcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50879 - RNA, 293 nt, synthetic construct
  source 1..293: mol_type = other RNA
cgctcttccgcgtctcgtcttcatgaacgagaaggaggacatcctgtggtgcactgaaatggtcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50880 - RNA, 293 nt, synthetic construct
  source 1..293: mol_type = other RNA
cgctcttccgcgtctcgtcttcatgaacgagaaggaggacatcctgtggtgcactgaaatggaagtcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50881 - RNA, 293 nt, synthetic construct
  source 1..293: mol_type = other RNA
cgctcttccgcgtctcgtcttcatgaacgagaaggaggacatcctgtggtgcactgaaatggaaagggtctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50882 - RNA, 293 nt, synthetic construct
  source 1..293: mol_type = other RNA
cgctcttccgcgtctcgtcttcatgaacgagaaggaggacatcctgtggtgcactgaaatggaaagggtggtcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50883 - RNA, 293 nt, synthetic construct
  source 1..293: mol_type = other RNA
cgctcttccgcgtctcgtcttcatgaacgagaaggaggacatcctgtggtgcactgaaatggaaagggtgtttgtcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50884 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgtccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50885 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcgtcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50886 - RNA, 293 nt, synthetic construct; identical to SEQ ID NO: 49292
  source 1..293: mol_type = other RNA

SEQ ID NO: 50887 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgtctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50888 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgtcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50889 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacgtcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50890 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagtcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50891 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50892 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggtcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50893 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgtcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50894 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgtcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50895 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggtccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50896 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgtcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50897 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgtcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50898 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggtcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50899 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggtccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50900 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggtcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50901 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggtcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50902 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagtcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50903 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggtcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50904 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggtccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50905 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgtctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50906 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggtctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50907 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggtcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50908 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggtcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50909 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50910 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggtcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50911 - RNA, 293 nt, synthetic construct; identical to SEQ ID NO: 49292
  source 1..293: mol_type = other RNA

SEQ ID NO: 50912 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgtccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50913 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgtccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50914 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgtcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50915 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgtcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50916 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgtcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50917 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgtcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50918 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgtcctgaaggaatattttgcttgtgtgtctagcggcaatagtaacgctaacagccgcgggccgagcttcagcagcggcctggtgccgttaagcttgcgcgagacgtcggaagagc

SEQ ID NO: 50919 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggtcaaggaatattttgcttgtgtgtctagcggcaatagtaacgctaacagccgcgggccgagcttcagcagcggcctggtgccgttaagcttgcgcgagacgtcggaagagc

SEQ ID NO: 50920 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggtcgaatattttgcttgtgtgtctagcggcaatagtaacgctaacagccgcgggccgagcttcagcagcggcctggtgccgttaagcttgcgcgagacgtcggaagagc

SEQ ID NO: 50921 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggtctattttgcttgtgtgtctagcggcaatagtaacgctaacagccgcgggccgagcttcagcagcggcctggtgccgttaagcttgcgcgagacgtcggaagagc

SEQ ID NO: 50922 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagtctttgcttgtgtgtctagcggcaatagtaacgctaacagccgcgggccgagcttcagcagcggcctggtgccgttaagcttgcgcgagacgtcggaagagc

SEQ ID NO: 50923 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgtcgcttgtgtgtctagcggcaatagtaacgctaacagccgcgggccgagcttcagcagcggcctggtgccgttaagcttgcgcgagacgtcggaagagc

SEQ ID NO: 50924 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgtctgtgtgtctagcggcaatagtaacgctaacagccgcgggccgagcttcagcagcggcctggtgccgttaagcttgcgcgagacgtcggaagagc

SEQ ID NO: 50925 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgtcgtgtctagcggcaatagtaacgctaacagccgcgggccgagcttcagcagcggcctggtgccgttaagcttgcgcgagacgtcggaagagc

SEQ ID NO: 50926 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtctctagcggcaatagtaacgctaacagccgcgggccgagcttcagcagcggcctggtgccgttaagcttgcgcgagacgtcggaagagc

SEQ ID NO: 50927 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggtcagcggcaatagtaacgctaacagccgcgggccgagcttcagcagcggcctggtgccgttaagcttgcgcgagacgtcggaagagc

SEQ ID NO: 50928 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgtcggcaatagtaacgctaacagccgcgggccgagcttcagcagcggcctggtgccgttaagcttgcgcgagacgtcggaagagc

SEQ ID NO: 50929 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgtcaatagtaacgctaacagccgcgggccgagcttcagcagcggcctggtgccgttaagcttgcgcgagacgtcggaagagc

SEQ ID NO: 50930 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgtcagtaacgctaacagccgcgggccgagcttcagcagcggcctggtgccgttaagcttgcgcgagacgtcggaagagc

SEQ ID NO: 50931 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgtcaacgctaacagccgcgggccgagcttcagcagcggcctggtgccgttaagcttgcgcgagacgtcggaagagc

SEQ ID NO: 50932 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgtcgctaacagccgcgggccgagcttcagcagcggcctggtgccgttaagcttgcgcgagacgtcggaagagc

SEQ ID NO: 50933 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgtcaacagccgcgggccgagcttcagcagcggcctggtgccgttaagcttgcgcgagacgtcggaagagc

SEQ ID NO: 50934 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgtcagccgcgggccgagcttcagcagcggcctggtgccgttaagcttgcgcgagacgtcggaagagc

SEQ ID NO: 50935 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgtccgcgggccgagcttcagcagcggcctggtgccgttaagcttgcgcgagacgtcggaagagc

SEQ ID NO: 50936 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgtcgggccgagcttcagcagcggcctggtgccgttaagcttgcgcgagacgtcggaagagc

SEQ ID NO: 50937 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgtcccgagcttcagcagcggcctggtgccgttaagcttgcgcgagacgtcggaagagc

SEQ ID NO: 50938 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggtcagcttcagcagcggcctggtgccgttaagcttgcgcgagacgtcggaagagc

SEQ ID NO: 50939 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggtcttcagcagcggcctggtgccgttaagcttgcgcgagacgtcggaagagc

SEQ ID NO: 50940 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgtcagcagcggcctggtgccgttaagcttgcgcgagacgtcggaagagc

SEQ ID NO: 50941 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgtcagcggcctggtgccgttaagcttgcgcgagacgtcggaagagc

SEQ ID NO: 50942 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgtcggcctggtgccgttaagcttgcgcgagacgtcggaagagc

SEQ ID NO: 50943 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgtcctggtgccgttaagcttgcgcgagacgtcggaagagc

SEQ ID NO: 50944 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgtcgtgccgttaagcttgcgcgagacgtcggaagagc

SEQ ID NO: 50945 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtcccgttaagcttgcgcgagacgtcggaagagc

SEQ ID NO: 50946 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggtcttaagcttgcgcgagacgtcggaagagc

SEQ ID NO: 50947 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggtcagcttgcgcgagacgtcggaagagc

SEQ ID NO: 50948 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagtcttgcgcgagacgtcggaagagc

SEQ ID NO: 50949 - RNA, 293 nt, synthetic construct
  source 1..293: mol_type = other RNA
cgctcttccgcgtctcgtcttcgggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50950 - RNA, 293 nt, synthetic construct
  source 1..293: mol_type = other RNA
cgctcttccgcgtctcgtcttcatgggggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50951 - RNA, 293 nt, synthetic construct
  source 1..293: mol_type = other RNA
cgctcttccgcgtctcgtcttcatgaacgggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50952 - RNA, 293 nt, synthetic construct
  source 1..293: mol_type = other RNA
cgctcttccgcgtctcgtcttcatgaacgagggggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50953 - RNA, 293 nt, synthetic construct
  source 1..293: mol_type = other RNA
cgctcttccgcgtctcgtcttcatgaacgagaagggggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50954 - RNA, 293 nt, synthetic construct
  source 1..293: mol_type = other RNA
cgctcttccgcgtctcgtcttcatgaacgagaaggaggggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50955 - RNA, 293 nt, synthetic construct
  source 1..293: mol_type = other RNA
cgctcttccgcgtctcgtcttcatgaacgagaaggaggacgggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50956 - RNA, 293 nt, synthetic construct
  source 1..293: mol_type = other RNA
cgctcttccgcgtctcgtcttcatgaacgagaaggaggacatcgggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50957 - RNA, 293 nt, synthetic construct
  source 1..293: mol_type = other RNA
cgctcttccgcgtctcgtcttcatgaacgagaaggaggacatcctggggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50958 - RNA, 293 nt, synthetic construct
  source 1..293: mol_type = other RNA
cgctcttccgcgtctcgtcttcatgaacgagaaggaggacatcctgtgggggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50959 - RNA, 293 nt, synthetic construct
  source 1..293: mol_type = other RNA
cgctcttccgcgtctcgtcttcatgaacgagaaggaggacatcctgtggtgcggggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50960 - RNA, 293 nt, synthetic construct
  source 1..293: mol_type = other RNA
cgctcttccgcgtctcgtcttcatgaacgagaaggaggacatcctgtggtgcactgggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50961 - RNA, 293 nt, synthetic construct
  source 1..293: mol_type = other RNA
cgctcttccgcgtctcgtcttcatgaacgagaaggaggacatcctgtggtgcactgaaggggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50962 - RNA, 293 nt, synthetic construct
  source 1..293: mol_type = other RNA
cgctcttccgcgtctcgtcttcatgaacgagaaggaggacatcctgtggtgcactgaaatggggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50963 - RNA, 293 nt, synthetic construct
  source 1..293: mol_type = other RNA
cgctcttccgcgtctcgtcttcatgaacgagaaggaggacatcctgtggtgcactgaaatggaaggggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50964 - RNA, 293 nt, synthetic construct
  source 1..293: mol_type = other RNA
cgctcttccgcgtctcgtcttcatgaacgagaaggaggacatcctgtggtgcactgaaatggaaagggggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50965 - RNA, 293 nt, synthetic construct
  source 1..293: mol_type = other RNA
cgctcttccgcgtctcgtcttcatgaacgagaaggaggacatcctgtggtgcactgaaatggaaagggtggggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50966 - RNA, 293 nt, synthetic construct
  source 1..293: mol_type = other RNA
cgctcttccgcgtctcgtcttcatgaacgagaaggaggacatcctgtggtgcactgaaatggaaagggtgtttgggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50967 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50968 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcggggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50969 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50970 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50971 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50972 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacggggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50973 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaggggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50974 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50975 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50976 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50977 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50978 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50979 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50980 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcggggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50981 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50982 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50983 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50984 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50985 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50986 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50987 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50988 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50989 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50990 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50991 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggggggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50992 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50993 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgggggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50994 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50995 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50996 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50997 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50998 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 50999 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcggggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51000 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51001 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgggctgaaggaatattttgcttgtgtgtctagcggcaatagtaacgctaacagccgcgggccgagcttcagcagcggcctggtgccgttaagcttgcgcgagacgtcggaagagc

SEQ ID NO: 51002 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggggaaggaatattttgcttgtgtgtctagcggcaatagtaacgctaacagccgcgggccgagcttcagcagcggcctggtgccgttaagcttgcgcgagacgtcggaagagc

SEQ ID NO: 51003 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgggggaatattttgcttgtgtgtctagcggcaatagtaacgctaacagccgcgggccgagcttcagcagcggcctggtgccgttaagcttgcgcgagacgtcggaagagc

SEQ ID NO: 51004 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggggtattttgcttgtgtgtctagcggcaatagtaacgctaacagccgcgggccgagcttcagcagcggcctggtgccgttaagcttgcgcgagacgtcggaagagc

SEQ ID NO: 51005 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagggtttgcttgtgtgtctagcggcaatagtaacgctaacagccgcgggccgagcttcagcagcggcctggtgccgttaagcttgcgcgagacgtcggaagagc

SEQ ID NO: 51006 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatggggcttgtgtgtctagcggcaatagtaacgctaacagccgcgggccgagcttcagcagcggcctggtgccgttaagcttgcgcgagacgtcggaagagc

SEQ ID NO: 51007 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgggtgtgtgtctagcggcaatagtaacgctaacagccgcgggccgagcttcagcagcggcctggtgccgttaagcttgcgcgagacgtcggaagagc

SEQ ID NO: 51008 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctggggtgtctagcggcaatagtaacgctaacagccgcgggccgagcttcagcagcggcctggtgccgttaagcttgcgcgagacgtcggaagagc

SEQ ID NO: 51009 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgggtctagcggcaatagtaacgctaacagccgcgggccgagcttcagcagcggcctggtgccgttaagcttgcgcgagacgtcggaagagc

SEQ ID NO: 51010 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggggagcggcaatagtaacgctaacagccgcgggccgagcttcagcagcggcctggtgccgttaagcttgcgcgagacgtcggaagagc

SEQ ID NO: 51011 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgggggcaatagtaacgctaacagccgcgggccgagcttcagcagcggcctggtgccgttaagcttgcgcgagacgtcggaagagc

SEQ ID NO: 51012 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgggaatagtaacgctaacagccgcgggccgagcttcagcagcggcctggtgccgttaagcttgcgcgagacgtcggaagagc

SEQ ID NO: 51013 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgggagtaacgctaacagccgcgggccgagcttcagcagcggcctggtgccgttaagcttgcgcgagacgtcggaagagc

SEQ ID NO: 51014 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgggaacgctaacagccgcgggccgagcttcagcagcggcctggtgccgttaagcttgcgcgagacgtcggaagagc

SEQ ID NO: 51015 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtggggctaacagccgcgggccgagcttcagcagcggcctggtgccgttaagcttgcgcgagacgtcggaagagc

SEQ ID NO: 51016 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgggaacagccgcgggccgagcttcagcagcggcctggtgccgttaagcttgcgcgagacgtcggaagagc

SEQ ID NO: 51017 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgggagccgcgggccgagcttcagcagcggcctggtgccgttaagcttgcgcgagacgtcggaagagc

SEQ ID NO: 51018 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgggcgcgggccgagcttcagcagcggcctggtgccgttaagcttgcgcgagacgtcggaagagc

SEQ ID NO: 51019 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcggggggccgagcttcagcagcggcctggtgccgttaagcttgcgcgagacgtcggaagagc

SEQ ID NO: 51020 - RNA, 293 nt, synthetic construct; identical to SEQ ID NO: 49292
  source 1..293: mol_type = other RNA

SEQ ID NO: 51021 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggggagcttcagcagcggcctggtgccgttaagcttgcgcgagacgtcggaagagc

SEQ ID NO: 51022 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggggttcagcagcggcctggtgccgttaagcttgcgcgagacgtcggaagagc

SEQ ID NO: 51023 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgggagcagcggcctggtgccgttaagcttgcgcgagacgtcggaagagc

SEQ ID NO: 51024 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgggagcggcctggtgccgttaagcttgcgcgagacgtcggaagagc

SEQ ID NO: 51025 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgggggcctggtgccgttaagcttgcgcgagacgtcggaagagc

SEQ ID NO: 51026 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgggctggtgccgttaagcttgcgcgagacgtcggaagagc

SEQ ID NO: 51027 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcggggtgccgttaagcttgcgcgagacgtcggaagagc

SEQ ID NO: 51028 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggggccgttaagcttgcgcgagacgtcggaagagc

SEQ ID NO: 51029 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggggttaagcttgcgcgagacgtcggaagagc

SEQ ID NO: 51030 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggggagcttgcgcgagacgtcggaagagc

SEQ ID NO: 51031 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagggttgcgcgagacgtcggaagagc

SEQ ID NO: 51032 - RNA, 293 nt, synthetic construct
  source 1..293: mol_type = other RNA
cgctcttccgcgtctcgtcttcggcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51033 - RNA, 293 nt, synthetic construct
  source 1..293: mol_type = other RNA
cgctcttccgcgtctcgtcttcatgggcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51034 - RNA, 293 nt, synthetic construct
  source 1..293: mol_type = other RNA
cgctcttccgcgtctcgtcttcatgaacggcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51035 - RNA, 293 nt, synthetic construct
  source 1..293: mol_type = other RNA
cgctcttccgcgtctcgtcttcatgaacgagggcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51036 - RNA, 293 nt, synthetic construct
  source 1..293: mol_type = other RNA
cgctcttccgcgtctcgtcttcatgaacgagaagggcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51037 - RNA, 293 nt, synthetic construct
  source 1..293: mol_type = other RNA
cgctcttccgcgtctcgtcttcatgaacgagaaggagggcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51038 - RNA, 293 nt, synthetic construct
  source 1..293: mol_type = other RNA
cgctcttccgcgtctcgtcttcatgaacgagaaggaggacggcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51039 - RNA, 293 nt, synthetic construct
  source 1..293: mol_type = other RNA
cgctcttccgcgtctcgtcttcatgaacgagaaggaggacatcggctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51040 - RNA, 293 nt, synthetic construct
  source 1..293: mol_type = other RNA
cgctcttccgcgtctcgtcttcatgaacgagaaggaggacatcctgggctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51041 - RNA, 293 nt, synthetic construct
  source 1..293: mol_type = other RNA
cgctcttccgcgtctcgtcttcatgaacgagaaggaggacatcctgtggggcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51042 - RNA, 293 nt, synthetic construct
  source 1..293: mol_type = other RNA
cgctcttccgcgtctcgtcttcatgaacgagaaggaggacatcctgtggtgcggcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51043 - RNA, 293 nt, synthetic construct
  source 1..293: mol_type = other RNA
cgctcttccgcgtctcgtcttcatgaacgagaaggaggacatcctgtggtgcactggcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51044 - RNA, 293 nt, synthetic construct
  source 1..293: mol_type = other RNA
cgctcttccgcgtctcgtcttcatgaacgagaaggaggacatcctgtggtgcactgaaggcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51045 - RNA, 293 nt, synthetic construct
  source 1..293: mol_type = other RNA
cgctcttccgcgtctcgtcttcatgaacgagaaggaggacatcctgtggtgcactgaaatgggcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51046 - RNA, 293 nt, synthetic construct
  source 1..293: mol_type = other RNA
cgctcttccgcgtctcgtcttcatgaacgagaaggaggacatcctgtggtgcactgaaatggaaggcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51047 - RNA, 293 nt, synthetic construct
  source 1..293: mol_type = other RNA
cgctcttccgcgtctcgtcttcatgaacgagaaggaggacatcctgtggtgcactgaaatggaaaggggctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51048 - RNA, 293 nt, synthetic construct
  source 1..293: mol_type = other RNA
cgctcttccgcgtctcgtcttcatgaacgagaaggaggacatcctgtggtgcactgaaatggaaagggtgggcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51049 - RNA, 293 nt, synthetic construct; identical to SEQ ID NO: 49292
  source 1..293: mol_type = other RNA

SEQ ID NO: 51050 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcggccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51051 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcggcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51052 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccggccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51053 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcggctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51054 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacggcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51055 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacggcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51056 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaggcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51057 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacggctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51058 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgggcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51059 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccggcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51060 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacggcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51061 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgggccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51062 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcggcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51063 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcggcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51064 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgggcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51065 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgggccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51066 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggggcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51067 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagggcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51068 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaggcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51069 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgggcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51070 - RNA, 293 nt, synthetic construct; identical to SEQ ID NO: 49292
  source 1..293: mol_type = other RNA

SEQ ID NO: 51071 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcggctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51072 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggggctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51073 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgggcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51074 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggggcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51075 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcggcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51076 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgggcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51077 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgggcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51078 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcggccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51079 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcggccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51080 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcggcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51081 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacggcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51082 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcggcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51083 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcggcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51084 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctggcctgaaggaatattttgcttgtgtgtctagcggcaatagtaacgctaacagccgcgggccgagcttcagcagcggcctggtgccgttaagcttgcgcgagacgtcggaagagc

SEQ ID NO: 51085 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgggcaaggaatattttgcttgtgtgtctagcggcaatagtaacgctaacagccgcgggccgagcttcagcagcggcctggtgccgttaagcttgcgcgagacgtcggaagagc

SEQ ID NO: 51086 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgggcgaatattttgcttgtgtgtctagcggcaatagtaacgctaacagccgcgggccgagcttcagcagcggcctggtgccgttaagcttgcgcgagacgtcggaagagc

SEQ ID NO: 51087 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagggctattttgcttgtgtgtctagcggcaatagtaacgctaacagccgcgggccgagcttcagcagcggcctggtgccgttaagcttgcgcgagacgtcggaagagc

SEQ ID NO: 51088 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaggctttgcttgtgtgtctagcggcaatagtaacgctaacagccgcgggccgagcttcagcagcggcctggtgccgttaagcttgcgcgagacgtcggaagagc

SEQ ID NO: 51089 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatggcgcttgtgtgtctagcggcaatagtaacgctaacagccgcgggccgagcttcagcagcggcctggtgccgttaagcttgcgcgagacgtcggaagagc

SEQ ID NO: 51090 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttggctgtgtgtctagcggcaatagtaacgctaacagccgcgggccgagcttcagcagcggcctggtgccgttaagcttgcgcgagacgtcggaagagc

SEQ ID NO: 51091 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctggcgtgtctagcggcaatagtaacgctaacagccgcgggccgagcttcagcagcggcctggtgccgttaagcttgcgcgagacgtcggaagagc

SEQ ID NO: 51092 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtggctctagcggcaatagtaacgctaacagccgcgggccgagcttcagcagcggcctggtgccgttaagcttgcgcgagacgtcggaagagc

SEQ ID NO: 51093 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgggcagcggcaatagtaacgctaacagccgcgggccgagcttcagcagcggcctggtgccgttaagcttgcgcgagacgtcggaagagc

SEQ ID NO: 51094 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctggcggcaatagtaacgctaacagccgcgggccgagcttcagcagcggcctggtgccgttaagcttgcgcgagacgtcggaagagc

SEQ ID NO: 51095 - RNA, 293 nt, synthetic construct; identical to SEQ ID NO: 49292
  source 1..293: mol_type = other RNA

SEQ ID NO: 51096 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcggcagtaacgctaacagccgcgggccgagcttcagcagcggcctggtgccgttaagcttgcgcgagacgtcggaagagc

SEQ ID NO: 51097 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatggcaacgctaacagccgcgggccgagcttcagcagcggcctggtgccgttaagcttgcgcgagacgtcggaagagc

SEQ ID NO: 51098 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtggcgctaacagccgcgggccgagcttcagcagcggcctggtgccgttaagcttgcgcgagacgtcggaagagc

SEQ ID NO: 51099 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacggcaacagccgcgggccgagcttcagcagcggcctggtgccgttaagcttgcgcgagacgtcggaagagc

SEQ ID NO: 51100 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctggcagccgcgggccgagcttcagcagcggcctggtgccgttaagcttgcgcgagacgtcggaagagc

SEQ ID NO: 51101 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacggccgcgggccgagcttcagcagcggcctggtgccgttaagcttgcgcgagacgtcggaagagc

SEQ ID NO: 51102 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcggcgggccgagcttcagcagcggcctggtgccgttaagcttgcgcgagacgtcggaagagc

SEQ ID NO: 51103 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggcccgagcttcagcagcggcctggtgccgttaagcttgcgcgagacgtcggaagagc

SEQ ID NO: 51104 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggggcagcttcagcagcggcctggtgccgttaagcttgcgcgagacgtcggaagagc

SEQ ID NO: 51105 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgggcttcagcagcggcctggtgccgttaagcttgcgcgagacgtcggaagagc

SEQ ID NO: 51106 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcggcagcagcggcctggtgccgttaagcttgcgcgagacgtcggaagagc

SEQ ID NO: 51107 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcggcagcggcctggtgccgttaagcttgcgcgagacgtcggaagagc

SEQ ID NO: 51108 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcggcggcctggtgccgttaagcttgcgcgagacgtcggaagagc

SEQ ID NO: 51109 - RNA, 293 nt, synthetic construct; identical to SEQ ID NO: 49292
  source 1..293: mol_type = other RNA

SEQ ID NO: 51110 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcggcgtgccgttaagcttgcgcgagacgtcggaagagc

SEQ ID NO: 51111 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgggcccgttaagcttgcgcgagacgtcggaagagc

SEQ ID NO: 51112 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgggcttaagcttgcgcgagacgtcggaagagc

SEQ ID NO: 51113 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgggcagcttgcgcgagacgtcggaagagc

SEQ ID NO: 51114 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaggcttgcgcgagacgtcggaagagc

SEQ ID NO: 51115 - RNA, 293 nt, synthetic construct
  source 1..293: mol_type = other RNA
cgctcttccgcgtctcgtcttcgcgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51116 - RNA, 293 nt, synthetic construct
  source 1..293: mol_type = other RNA
cgctcttccgcgtctcgtcttcatggcggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51117 - RNA, 293 nt, synthetic construct
  source 1..293: mol_type = other RNA
cgctcttccgcgtctcgtcttcatgaacgcgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51118 - RNA, 293 nt, synthetic construct
  source 1..293: mol_type = other RNA
cgctcttccgcgtctcgtcttcatgaacgaggcggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51119 - RNA, 293 nt, synthetic construct
  source 1..293: mol_type = other RNA
cgctcttccgcgtctcgtcttcatgaacgagaaggcggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51120 - RNA, 293 nt, synthetic construct
  source 1..293: mol_type = other RNA
cgctcttccgcgtctcgtcttcatgaacgagaaggaggcgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51121 - RNA, 293 nt, synthetic construct
  source 1..293: mol_type = other RNA
cgctcttccgcgtctcgtcttcatgaacgagaaggaggacgcgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51122 - RNA, 293 nt, synthetic construct
  source 1..293: mol_type = other RNA
cgctcttccgcgtctcgtcttcatgaacgagaaggaggacatcgcgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51123 - RNA, 293 nt, synthetic construct
  source 1..293: mol_type = other RNA
cgctcttccgcgtctcgtcttcatgaacgagaaggaggacatcctggcgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51124 - RNA, 293 nt, synthetic construct
  source 1..293: mol_type = other RNA
cgctcttccgcgtctcgtcttcatgaacgagaaggaggacatcctgtgggcgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51125 - RNA, 293 nt, synthetic construct
  source 1..293: mol_type = other RNA
cgctcttccgcgtctcgtcttcatgaacgagaaggaggacatcctgtggtgcgcggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51126 - RNA, 293 nt, synthetic construct
  source 1..293: mol_type = other RNA
cgctcttccgcgtctcgtcttcatgaacgagaaggaggacatcctgtggtgcactgcgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51127 - RNA, 293 nt, synthetic construct
  source 1..293: mol_type = other RNA
cgctcttccgcgtctcgtcttcatgaacgagaaggaggacatcctgtggtgcactgaagcggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51128 - RNA, 293 nt, synthetic construct
  source 1..293: mol_type = other RNA
cgctcttccgcgtctcgtcttcatgaacgagaaggaggacatcctgtggtgcactgaaatggcgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51129 - RNA, 293 nt, synthetic construct
  source 1..293: mol_type = other RNA
cgctcttccgcgtctcgtcttcatgaacgagaaggaggacatcctgtggtgcactgaaatggaagcggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51130 - RNA, 293 nt, synthetic construct
  source 1..293: mol_type = other RNA
cgctcttccgcgtctcgtcttcatgaacgagaaggaggacatcctgtggtgcactgaaatggaaagggcgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51131 - RNA, 293 nt, synthetic construct
  source 1..293: mol_type = other RNA
cgctcttccgcgtctcgtcttcatgaacgagaaggaggacatcctgtggtgcactgaaatggaaagggtggcgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51132 - RNA, 293 nt, synthetic construct
  source 1..293: mol_type = other RNA
cgctcttccgcgtctcgtcttcatgaacgagaaggaggacatcctgtggtgcactgaaatggaaagggtgtttgcgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51133 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgcgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51134 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcgcggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51135 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgcgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51136 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgcgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51137 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgcgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51138 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacgcggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51139 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagcggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51140 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgcgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51141 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggcgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51142 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgcgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51143 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgcgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51144 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggcgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51145 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgcgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51146 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgcggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51147 - RNA, 293 nt, synthetic construct; identical to SEQ ID NO: 49292
  source 1..293: mol_type = other RNA

SEQ ID NO: 51148 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggcgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51149 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggcgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51150 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggcgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51151 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagcgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51152 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggcgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51153 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggcgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51154 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgcgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51155 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51156 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggcgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51157 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggcggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51158 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgcgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51159 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggcggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51160 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggcgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51161 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgcgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51162 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgcgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51163 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgcgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51164 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgcgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51165 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgcggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51166 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51167 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgcgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51168 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggcgaaggaatattttgcttgtgtgtctagcggcaatagtaacgctaacagccgcgggccgagcttcagcagcggcctggtgccgttaagcttgcgcgagacgtcggaagagc

SEQ ID NO: 51169 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggcggaatattttgcttgtgtgtctagcggcaatagtaacgctaacagccgcgggccgagcttcagcagcggcctggtgccgttaagcttgcgcgagacgtcggaagagc

SEQ ID NO: 51170 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggcgtattttgcttgtgtgtctagcggcaatagtaacgctaacagccgcgggccgagcttcagcagcggcctggtgccgttaagcttgcgcgagacgtcggaagagc

SEQ ID NO: 51171 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagcgtttgcttgtgtgtctagcggcaatagtaacgctaacagccgcgggccgagcttcagcagcggcctggtgccgttaagcttgcgcgagacgtcggaagagc

SEQ ID NO: 51172 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgcggcttgtgtgtctagcggcaatagtaacgctaacagccgcgggccgagcttcagcagcggcctggtgccgttaagcttgcgcgagacgtcggaagagc

SEQ ID NO: 51173 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcgtgtgtgtctagcggcaatagtaacgctaacagccgcgggccgagcttcagcagcggcctggtgccgttaagcttgcgcgagacgtcggaagagc

SEQ ID NO: 51174 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgcggtgtctagcggcaatagtaacgctaacagccgcgggccgagcttcagcagcggcctggtgccgttaagcttgcgcgagacgtcggaagagc

SEQ ID NO: 51175 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgcgtctagcggcaatagtaacgctaacagccgcgggccgagcttcagcagcggcctggtgccgttaagcttgcgcgagacgtcggaagagc

SEQ ID NO: 51176 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggcgagcggcaatagtaacgctaacagccgcgggccgagcttcagcagcggcctggtgccgttaagcttgcgcgagacgtcggaagagc

SEQ ID NO: 51177 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgcgggcaatagtaacgctaacagccgcgggccgagcttcagcagcggcctggtgccgttaagcttgcgcgagacgtcggaagagc

SEQ ID NO: 51178 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgcgaatagtaacgctaacagccgcgggccgagcttcagcagcggcctggtgccgttaagcttgcgcgagacgtcggaagagc

SEQ ID NO: 51179 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgcgagtaacgctaacagccgcgggccgagcttcagcagcggcctggtgccgttaagcttgcgcgagacgtcggaagagc

SEQ ID NO: 51180 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgcgaacgctaacagccgcgggccgagcttcagcagcggcctggtgccgttaagcttgcgcgagacgtcggaagagc

SEQ ID NO: 51181 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgcggctaacagccgcgggccgagcttcagcagcggcctggtgccgttaagcttgcgcgagacgtcggaagagc

SEQ ID NO: 51182 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcgaacagccgcgggccgagcttcagcagcggcctggtgccgttaagcttgcgcgagacgtcggaagagc

SEQ ID NO: 51183 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgcgagccgcgggccgagcttcagcagcggcctggtgccgttaagcttgcgcgagacgtcggaagagc

SEQ ID NO: 51184 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgcgcgcgggccgagcttcagcagcggcctggtgccgttaagcttgcgcgagacgtcggaagagc

SEQ ID NO: 51185 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgcggggccgagcttcagcagcggcctggtgccgttaagcttgcgcgagacgtcggaagagc

SEQ ID NO: 51186 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgcgccgagcttcagcagcggcctggtgccgttaagcttgcgcgagacgtcggaagagc

SEQ ID NO: 51187 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggcgagcttcagcagcggcctggtgccgttaagcttgcgcgagacgtcggaagagc

SEQ ID NO: 51188 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggcgttcagcagcggcctggtgccgttaagcttgcgcgagacgtcggaagagc

SEQ ID NO: 51189 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgcgagcagcggcctggtgccgttaagcttgcgcgagacgtcggaagagc

SEQ ID NO: 51190 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgcgagcggcctggtgccgttaagcttgcgcgagacgtcggaagagc

SEQ ID NO: 51191 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgcgggcctggtgccgttaagcttgcgcgagacgtcggaagagc

SEQ ID NO: 51192 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgcgctggtgccgttaagcttgcgcgagacgtcggaagagc

SEQ ID NO: 51193 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgcggtgccgttaagcttgcgcgagacgtcggaagagc

SEQ ID NO: 51194 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggcgccgttaagcttgcgcgagacgtcggaagagc

SEQ ID NO: 51195 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggcgttaagcttgcgcgagacgtcggaagagc

SEQ ID NO: 51196 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggcgagcttgcgcgagacgtcggaagagc

SEQ ID NO: 51197 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagcgttgcgcgagacgtcggaagagc

SEQ ID NO: 51198 - RNA, 293 nt, synthetic construct
  source 1..293: mol_type = other RNA
cgctcttccgcgtctcgtcttcgccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51199 - RNA, 293 nt, synthetic construct
  source 1..293: mol_type = other RNA
cgctcttccgcgtctcgtcttcatggccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51200 - RNA, 293 nt, synthetic construct
  source 1..293: mol_type = other RNA
cgctcttccgcgtctcgtcttcatgaacgccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51201 - RNA, 293 nt, synthetic construct
  source 1..293: mol_type = other RNA
cgctcttccgcgtctcgtcttcatgaacgaggccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51202 - RNA, 293 nt, synthetic construct
  source 1..293: mol_type = other RNA
cgctcttccgcgtctcgtcttcatgaacgagaaggccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51203 - RNA, 293 nt, synthetic construct
  source 1..293: mol_type = other RNA
cgctcttccgcgtctcgtcttcatgaacgagaaggaggccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51204 - RNA, 293 nt, synthetic construct
  source 1..293: mol_type = other RNA
cgctcttccgcgtctcgtcttcatgaacgagaaggaggacgccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51205 - RNA, 293 nt, synthetic construct
  source 1..293: mol_type = other RNA
cgctcttccgcgtctcgtcttcatgaacgagaaggaggacatcgcctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51206 - RNA, 293 nt, synthetic construct
  source 1..293: mol_type = other RNA
cgctcttccgcgtctcgtcttcatgaacgagaaggaggacatcctggcctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51207 - RNA, 293 nt, synthetic construct
  source 1..293: mol_type = other RNA
cgctcttccgcgtctcgtcttcatgaacgagaaggaggacatcctgtgggccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51208 - RNA, 293 nt, synthetic construct
  source 1..293: mol_type = other RNA
cgctcttccgcgtctcgtcttcatgaacgagaaggaggacatcctgtggtgcgccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51209 - RNA, 293 nt, synthetic construct
  source 1..293: mol_type = other RNA
cgctcttccgcgtctcgtcttcatgaacgagaaggaggacatcctgtggtgcactgccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51210 - RNA, 293 nt, synthetic construct
  source 1..293: mol_type = other RNA
cgctcttccgcgtctcgtcttcatgaacgagaaggaggacatcctgtggtgcactgaagccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51211 - RNA, 293 nt, synthetic construct
  source 1..293: mol_type = other RNA
cgctcttccgcgtctcgtcttcatgaacgagaaggaggacatcctgtggtgcactgaaatggccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51212 - RNA, 293 nt, synthetic construct
  source 1..293: mol_type = other RNA
cgctcttccgcgtctcgtcttcatgaacgagaaggaggacatcctgtggtgcactgaaatggaagccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51213 - RNA, 293 nt, synthetic construct
  source 1..293: mol_type = other RNA
cgctcttccgcgtctcgtcttcatgaacgagaaggaggacatcctgtggtgcactgaaatggaaagggcctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51214 - RNA, 293 nt, synthetic construct
  source 1..293: mol_type = other RNA
cgctcttccgcgtctcgtcttcatgaacgagaaggaggacatcctgtggtgcactgaaatggaaagggtggccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51215 - RNA, 293 nt, synthetic construct
  source 1..293: mol_type = other RNA
cgctcttccgcgtctcgtcttcatgaacgagaaggaggacatcctgtggtgcactgaaatggaaagggtgtttgccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51216 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcgcccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51217 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcgccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51218 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgcccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51219 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcgcctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51220 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacgccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51221 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacgccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51222 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51223 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgcctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51224 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtggccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51225 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccgccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51226 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacgccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51227 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatggcccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51228 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcgccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51229 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51230 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51231 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggcccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51232 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51233 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51234 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51235 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51236 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggcccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51237 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgcctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51238 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggcctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51239 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51240 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51241 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51242 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51243 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51244 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgcccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51245 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgcccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51246 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51247 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51248 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51249 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51250 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgccctgaaggaatattttgcttgtgtgtctagcggcaatagtaacgctaacagccgcgggccgagcttcagcagcggcctggtgccgttaagcttgcgcgagacgtcggaagagc

SEQ ID NO: 51251 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggccaaggaatattttgcttgtgtgtctagcggcaatagtaacgctaacagccgcgggccgagcttcagcagcggcctggtgccgttaagcttgcgcgagacgtcggaagagc

SEQ ID NO: 51252 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggccgaatattttgcttgtgtgtctagcggcaatagtaacgctaacagccgcgggccgagcttcagcagcggcctggtgccgttaagcttgcgcgagacgtcggaagagc

SEQ ID NO: 51253 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggcctattttgcttgtgtgtctagcggcaatagtaacgctaacagccgcgggccgagcttcagcagcggcctggtgccgttaagcttgcgcgagacgtcggaagagc

SEQ ID NO: 51254 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagcctttgcttgtgtgtctagcggcaatagtaacgctaacagccgcgggccgagcttcagcagcggcctggtgccgttaagcttgcgcgagacgtcggaagagc

SEQ ID NO: 51255 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgccgcttgtgtgtctagcggcaatagtaacgctaacagccgcgggccgagcttcagcagcggcctggtgccgttaagcttgcgcgagacgtcggaagagc

SEQ ID NO: 51256 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcctgtgtgtctagcggcaatagtaacgctaacagccgcgggccgagcttcagcagcggcctggtgccgttaagcttgcgcgagacgtcggaagagc

SEQ ID NO: 51257 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgccgtgtctagcggcaatagtaacgctaacagccgcgggccgagcttcagcagcggcctggtgccgttaagcttgcgcgagacgtcggaagagc

SEQ ID NO: 51258 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgcctctagcggcaatagtaacgctaacagccgcgggccgagcttcagcagcggcctggtgccgttaagcttgcgcgagacgtcggaagagc

SEQ ID NO: 51259 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggccagcggcaatagtaacgctaacagccgcgggccgagcttcagcagcggcctggtgccgttaagcttgcgcgagacgtcggaagagc

SEQ ID NO: 51260 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgccggcaatagtaacgctaacagccgcgggccgagcttcagcagcggcctggtgccgttaagcttgcgcgagacgtcggaagagc

SEQ ID NO: 51261 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgccaatagtaacgctaacagccgcgggccgagcttcagcagcggcctggtgccgttaagcttgcgcgagacgtcggaagagc

SEQ ID NO: 51262 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgccagtaacgctaacagccgcgggccgagcttcagcagcggcctggtgccgttaagcttgcgcgagacgtcggaagagc

SEQ ID NO: 51263 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgccaacgctaacagccgcgggccgagcttcagcagcggcctggtgccgttaagcttgcgcgagacgtcggaagagc

SEQ ID NO: 51264 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgccgctaacagccgcgggccgagcttcagcagcggcctggtgccgttaagcttgcgcgagacgtcggaagagc

SEQ ID NO: 51265 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgccaacagccgcgggccgagcttcagcagcggcctggtgccgttaagcttgcgcgagacgtcggaagagc

SEQ ID NO: 51266 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgccagccgcgggccgagcttcagcagcggcctggtgccgttaagcttgcgcgagacgtcggaagagc

SEQ ID NO: 51267 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgcccgcgggccgagcttcagcagcggcctggtgccgttaagcttgcgcgagacgtcggaagagc

SEQ ID NO: 51268 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgccgggccgagcttcagcagcggcctggtgccgttaagcttgcgcgagacgtcggaagagc

SEQ ID NO: 51269 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgccccgagcttcagcagcggcctggtgccgttaagcttgcgcgagacgtcggaagagc

SEQ ID NO: 51270 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggccagcttcagcagcggcctggtgccgttaagcttgcgcgagacgtcggaagagc

SEQ ID NO: 51271 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggccttcagcagcggcctggtgccgttaagcttgcgcgagacgtcggaagagc

SEQ ID NO: 51272 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgccagcagcggcctggtgccgttaagcttgcgcgagacgtcggaagagc

SEQ ID NO: 51273 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgccagcggcctggtgccgttaagcttgcgcgagacgtcggaagagc

SEQ ID NO: 51274 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgccggcctggtgccgttaagcttgcgcgagacgtcggaagagc

SEQ ID NO: 51275 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgccctggtgccgttaagcttgcgcgagacgtcggaagagc

SEQ ID NO: 51276 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgccgtgccgttaagcttgcgcgagacgtcggaagagc

SEQ ID NO: 51277 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggccccgttaagcttgcgcgagacgtcggaagagc

SEQ ID NO: 51278 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggccttaagcttgcgcgagacgtcggaagagc

SEQ ID NO: 51279 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggccagcttgcgcgagacgtcggaagagc

SEQ ID NO: 51280 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagccttgcgcgagacgtcggaagagc

SEQ ID NO: 51281 - RNA, 293 nt, synthetic construct
  source 1..293: mol_type = other RNA
cgctcttccgcgtctcgtcttccagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51282 - RNA, 293 nt, synthetic construct
  source 1..293: mol_type = other RNA
cgctcttccgcgtctcgtcttcatgcaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51283 - RNA, 293 nt, synthetic construct
  source 1..293: mol_type = other RNA
cgctcttccgcgtctcgtcttcatgaaccagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51284 - RNA, 293 nt, synthetic construct
  source 1..293: mol_type = other RNA
cgctcttccgcgtctcgtcttcatgaacgagcaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51285 - RNA, 293 nt, synthetic construct
  source 1..293: mol_type = other RNA
cgctcttccgcgtctcgtcttcatgaacgagaagcaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51286 - RNA, 293 nt, synthetic construct
  source 1..293: mol_type = other RNA
cgctcttccgcgtctcgtcttcatgaacgagaaggagcagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51287 - RNA, 293 nt, synthetic construct
  source 1..293: mol_type = other RNA
cgctcttccgcgtctcgtcttcatgaacgagaaggaggaccagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51288 - RNA, 293 nt, synthetic construct
  source 1..293: mol_type = other RNA
cgctcttccgcgtctcgtcttcatgaacgagaaggaggacatccagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51289 - RNA, 293 nt, synthetic construct
  source 1..293: mol_type = other RNA
cgctcttccgcgtctcgtcttcatgaacgagaaggaggacatcctgcagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51290 - RNA, 293 nt, synthetic construct
  source 1..293: mol_type = other RNA
cgctcttccgcgtctcgtcttcatgaacgagaaggaggacatcctgtggcagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51291 - RNA, 293 nt, synthetic construct
  source 1..293: mol_type = other RNA
cgctcttccgcgtctcgtcttcatgaacgagaaggaggacatcctgtggtgccaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51292 - RNA, 293 nt, synthetic construct
  source 1..293: mol_type = other RNA
cgctcttccgcgtctcgtcttcatgaacgagaaggaggacatcctgtggtgcactcagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51293 - RNA, 293 nt, synthetic construct
  source 1..293: mol_type = other RNA
cgctcttccgcgtctcgtcttcatgaacgagaaggaggacatcctgtggtgcactgaacaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51294 - RNA, 293 nt, synthetic construct
  source 1..293: mol_type = other RNA
cgctcttccgcgtctcgtcttcatgaacgagaaggaggacatcctgtggtgcactgaaatgcagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51295 - RNA, 293 nt, synthetic construct
  source 1..293: mol_type = other RNA
cgctcttccgcgtctcgtcttcatgaacgagaaggaggacatcctgtggtgcactgaaatggaacaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51296 - RNA, 293 nt, synthetic construct
  source 1..293: mol_type = other RNA
cgctcttccgcgtctcgtcttcatgaacgagaaggaggacatcctgtggtgcactgaaatggaaaggcagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51297 - RNA, 293 nt, synthetic construct
  source 1..293: mol_type = other RNA
cgctcttccgcgtctcgtcttcatgaacgagaaggaggacatcctgtggtgcactgaaatggaaagggtgcagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51298 - RNA, 293 nt, synthetic construct
  source 1..293: mol_type = other RNA
cgctcttccgcgtctcgtcttcatgaacgagaaggaggacatcctgtggtgcactgaaatggaaagggtgtttcagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51299 - RNA, 293 nt, synthetic construct
  source 1..293: mol_type = other RNA
cgctcttccgcgtctcgtcttcatgaacgagaaggaggacatcctgtggtgcactgaaatggaaagggtgtttggccagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51300 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51301 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccccagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51302 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51303 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccaccagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51304 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactaccaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51305 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacacaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51306 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagaccagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51307 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgcagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51308 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcccagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51309 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaaccagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51310 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgcagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51311 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51312 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgccaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51313 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51314 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51315 - RNA, 293 nt, synthetic construct; identical to SEQ ID NO: 49292
  source 1..293: mol_type = other RNA

SEQ ID NO: 51316 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51317 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51318 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51319 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51320 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51321 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51322 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51323 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51324 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51325 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51326 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51327 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51328 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51329 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51330 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51331 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51332 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51333 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcagctgaaggaatattttgcttgtgtgtctagcggcaatagtaacgctaacagccgcgggccgagcttcagcagcggcctggtgccgttaagcttgcgcgagacgtcggaagagc

SEQ ID NO: 51334 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcagaaggaatattttgcttgtgtgtctagcggcaatagtaacgctaacagccgcgggccgagcttcagcagcggcctggtgccgttaagcttgcgcgagacgtcggaagagc

SEQ ID NO: 51335 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcaggaatattttgcttgtgtgtctagcggcaatagtaacgctaacagccgcgggccgagcttcagcagcggcctggtgccgttaagcttgcgcgagacgtcggaagagc

SEQ ID NO: 51336 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcagtattttgcttgtgtgtctagcggcaatagtaacgctaacagccgcgggccgagcttcagcagcggcctggtgccgttaagcttgcgcgagacgtcggaagagc

SEQ ID NO: 51337 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacagtttgcttgtgtgtctagcggcaatagtaacgctaacagccgcgggccgagcttcagcagcggcctggtgccgttaagcttgcgcgagacgtcggaagagc

SEQ ID NO: 51338 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcaggcttgtgtgtctagcggcaatagtaacgctaacagccgcgggccgagcttcagcagcggcctggtgccgttaagcttgcgcgagacgtcggaagagc

SEQ ID NO: 51339 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcagtgtgtgtctagcggcaatagtaacgctaacagccgcgggccgagcttcagcagcggcctggtgccgttaagcttgcgcgagacgtcggaagagc

SEQ ID NO: 51340 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcaggtgtctagcggcaatagtaacgctaacagccgcgggccgagcttcagcagcggcctggtgccgttaagcttgcgcgagacgtcggaagagc

SEQ ID NO: 51341 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcagtctagcggcaatagtaacgctaacagccgcgggccgagcttcagcagcggcctggtgccgttaagcttgcgcgagacgtcggaagagc

SEQ ID NO: 51342 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcagagcggcaatagtaacgctaacagccgcgggccgagcttcagcagcggcctggtgccgttaagcttgcgcgagacgtcggaagagc

SEQ ID NO: 51343 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcagggcaatagtaacgctaacagccgcgggccgagcttcagcagcggcctggtgccgttaagcttgcgcgagacgtcggaagagc

SEQ ID NO: 51344 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccagaatagtaacgctaacagccgcgggccgagcttcagcagcggcctggtgccgttaagcttgcgcgagacgtcggaagagc

SEQ ID NO: 51345 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccagagtaacgctaacagccgcgggccgagcttcagcagcggcctggtgccgttaagcttgcgcgagacgtcggaagagc

SEQ ID NO: 51346 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcagaacgctaacagccgcgggccgagcttcagcagcggcctggtgccgttaagcttgcgcgagacgtcggaagagc

SEQ ID NO: 51347 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcaggctaacagccgcgggccgagcttcagcagcggcctggtgccgttaagcttgcgcgagacgtcggaagagc

SEQ ID NO: 51348 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccagaacagccgcgggccgagcttcagcagcggcctggtgccgttaagcttgcgcgagacgtcggaagagc

SEQ ID NO: 51349 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcagagccgcgggccgagcttcagcagcggcctggtgccgttaagcttgcgcgagacgtcggaagagc

SEQ ID NO: 51350 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccagcgcgggccgagcttcagcagcggcctggtgccgttaagcttgcgcgagacgtcggaagagc

SEQ ID NO: 51351 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccaggggccgagcttcagcagcggcctggtgccgttaagcttgcgcgagacgtcggaagagc

SEQ ID NO: 51352 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccagccgagcttcagcagcggcctggtgccgttaagcttgcgcgagacgtcggaagagc

SEQ ID NO: 51353 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcagagcttcagcagcggcctggtgccgttaagcttgcgcgagacgtcggaagagc

SEQ ID NO: 51354 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcagttcagcagcggcctggtgccgttaagcttgcgcgagacgtcggaagagc

SEQ ID NO: 51355 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccagagcagcggcctggtgccgttaagcttgcgcgagacgtcggaagagc

SEQ ID NO: 51356 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccagagcggcctggtgccgttaagcttgcgcgagacgtcggaagagc

SEQ ID NO: 51357 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccagggcctggtgccgttaagcttgcgcgagacgtcggaagagc

SEQ ID NO: 51358 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccagctggtgccgttaagcttgcgcgagacgtcggaagagc

SEQ ID NO: 51359 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccaggtgccgttaagcttgcgcgagacgtcggaagagc

SEQ ID NO: 51360 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcagccgttaagcttgcgcgagacgtcggaagagc

SEQ ID NO: 51361 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcagttaagcttgcgcgagacgtcggaagagc

SEQ ID NO: 51362 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcagagcttgcgcgagacgtcggaagagc

SEQ ID NO: 51363 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacagttgcgcgagacgtcggaagagc

SEQ ID NO: 51364 - RNA, 293 nt, synthetic construct
  source 1..293: mol_type = other RNA
cgctcttccgcgtctcgtcttccacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51365 - RNA, 293 nt, synthetic construct
  source 1..293: mol_type = other RNA
cgctcttccgcgtctcgtcttcatgcacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51366 - RNA, 293 nt, synthetic construct
  source 1..293: mol_type = other RNA
cgctcttccgcgtctcgtcttcatgaaccacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51367 - RNA, 293 nt, synthetic construct
  source 1..293: mol_type = other RNA
cgctcttccgcgtctcgtcttcatgaacgagcacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51368 - RNA, 293 nt, synthetic construct
  source 1..293: mol_type = other RNA
cgctcttccgcgtctcgtcttcatgaacgagaagcacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51369 - RNA, 293 nt, synthetic construct
  source 1..293: mol_type = other RNA
cgctcttccgcgtctcgtcttcatgaacgagaaggagcacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51370 - RNA, 293 nt, synthetic construct
  source 1..293: mol_type = other RNA
cgctcttccgcgtctcgtcttcatgaacgagaaggaggaccacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51371 - RNA, 293 nt, synthetic construct
  source 1..293: mol_type = other RNA
cgctcttccgcgtctcgtcttcatgaacgagaaggaggacatccactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51372 - RNA, 293 nt, synthetic construct
  source 1..293: mol_type = other RNA
cgctcttccgcgtctcgtcttcatgaacgagaaggaggacatcctgcactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51373 - RNA, 293 nt, synthetic construct
  source 1..293: mol_type = other RNA
cgctcttccgcgtctcgtcttcatgaacgagaaggaggacatcctgtggcacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51374 - RNA, 293 nt, synthetic construct
  source 1..293: mol_type = other RNA
cgctcttccgcgtctcgtcttcatgaacgagaaggaggacatcctgtggtgccacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51375 - RNA, 293 nt, synthetic construct
  source 1..293: mol_type = other RNA
cgctcttccgcgtctcgtcttcatgaacgagaaggaggacatcctgtggtgcactcacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51376 - RNA, 293 nt, synthetic construct
  source 1..293: mol_type = other RNA
cgctcttccgcgtctcgtcttcatgaacgagaaggaggacatcctgtggtgcactgaacacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51377 - RNA, 293 nt, synthetic construct
  source 1..293: mol_type = other RNA
cgctcttccgcgtctcgtcttcatgaacgagaaggaggacatcctgtggtgcactgaaatgcacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51378 - RNA, 293 nt, synthetic construct
  source 1..293: mol_type = other RNA
cgctcttccgcgtctcgtcttcatgaacgagaaggaggacatcctgtggtgcactgaaatggaacacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51379 - RNA, 293 nt, synthetic construct
  source 1..293: mol_type = other RNA
cgctcttccgcgtctcgtcttcatgaacgagaaggaggacatcctgtggtgcactgaaatggaaaggcactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51380 - RNA, 293 nt, synthetic construct
  source 1..293: mol_type = other RNA
cgctcttccgcgtctcgtcttcatgaacgagaaggaggacatcctgtggtgcactgaaatggaaagggtgcacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51381 - RNA, 293 nt, synthetic construct
  source 1..293: mol_type = other RNA
cgctcttccgcgtctcgtcttcatgaacgagaaggaggacatcctgtggtgcactgaaatggaaagggtgtttcacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51382 - RNA, 293 nt, synthetic construct
  source 1..293: mol_type = other RNA
cgctcttccgcgtctcgtcttcatgaacgagaaggaggacatcctgtggtgcactgaaatggaaagggtgtttggccaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51383 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51384 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccccaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51385 - RNA, 293 nt, synthetic construct; identical to SEQ ID NO: 49292
  source 1..293: mol_type = other RNA

SEQ ID NO: 51386 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccaccacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51387 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactaccacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51388 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacacacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51389 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagaccactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51390 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgcacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51391 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcccacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51392 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaaccacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51393 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgcaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51394 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51395 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgccacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51396 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51397 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51398 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51399 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51400 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51401 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51402 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51403 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51404 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51405 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51406 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51407 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51408 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51409 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51410 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51411 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51412 - RNA, 293 nt, synthetic construct; identical to SEQ ID NO: 49292
  source 1..293: mol_type = other RNA

SEQ ID NO: 51413 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51414 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51415 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51416 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcacctgaaggaatattttgcttgtgtgtctagcggcaatagtaacgctaacagccgcgggccgagcttcagcagcggcctggtgccgttaagcttgcgcgagacgtcggaagagc

SEQ ID NO: 51417 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcacaaggaatattttgcttgtgtgtctagcggcaatagtaacgctaacagccgcgggccgagcttcagcagcggcctggtgccgttaagcttgcgcgagacgtcggaagagc

SEQ ID NO: 51418 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcacgaatattttgcttgtgtgtctagcggcaatagtaacgctaacagccgcgggccgagcttcagcagcggcctggtgccgttaagcttgcgcgagacgtcggaagagc

SEQ ID NO: 51419 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcactattttgcttgtgtgtctagcggcaatagtaacgctaacagccgcgggccgagcttcagcagcggcctggtgccgttaagcttgcgcgagacgtcggaagagc

SEQ ID NO: 51420 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacactttgcttgtgtgtctagcggcaatagtaacgctaacagccgcgggccgagcttcagcagcggcctggtgccgttaagcttgcgcgagacgtcggaagagc

SEQ ID NO: 51421 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcacgcttgtgtgtctagcggcaatagtaacgctaacagccgcgggccgagcttcagcagcggcctggtgccgttaagcttgcgcgagacgtcggaagagc

SEQ ID NO: 51422 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcactgtgtgtctagcggcaatagtaacgctaacagccgcgggccgagcttcagcagcggcctggtgccgttaagcttgcgcgagacgtcggaagagc

SEQ ID NO: 51423 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcacgtgtctagcggcaatagtaacgctaacagccgcgggccgagcttcagcagcggcctggtgccgttaagcttgcgcgagacgtcggaagagc

SEQ ID NO: 51424 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcactctagcggcaatagtaacgctaacagccgcgggccgagcttcagcagcggcctggtgccgttaagcttgcgcgagacgtcggaagagc

SEQ ID NO: 51425 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcacagcggcaatagtaacgctaacagccgcgggccgagcttcagcagcggcctggtgccgttaagcttgcgcgagacgtcggaagagc

SEQ ID NO: 51426 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcacggcaatagtaacgctaacagccgcgggccgagcttcagcagcggcctggtgccgttaagcttgcgcgagacgtcggaagagc

SEQ ID NO: 51427 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccacaatagtaacgctaacagccgcgggccgagcttcagcagcggcctggtgccgttaagcttgcgcgagacgtcggaagagc

SEQ ID NO: 51428 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccacagtaacgctaacagccgcgggccgagcttcagcagcggcctggtgccgttaagcttgcgcgagacgtcggaagagc

SEQ ID NO: 51429 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcacaacgctaacagccgcgggccgagcttcagcagcggcctggtgccgttaagcttgcgcgagacgtcggaagagc

SEQ ID NO: 51430 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcacgctaacagccgcgggccgagcttcagcagcggcctggtgccgttaagcttgcgcgagacgtcggaagagc

SEQ ID NO: 51431 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccacaacagccgcgggccgagcttcagcagcggcctggtgccgttaagcttgcgcgagacgtcggaagagc

SEQ ID NO: 51432 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcacagccgcgggccgagcttcagcagcggcctggtgccgttaagcttgcgcgagacgtcggaagagc

SEQ ID NO: 51433 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccaccgcgggccgagcttcagcagcggcctggtgccgttaagcttgcgcgagacgtcggaagagc

SEQ ID NO: 51434 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccacgggccgagcttcagcagcggcctggtgccgttaagcttgcgcgagacgtcggaagagc

SEQ ID NO: 51435 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccacccgagcttcagcagcggcctggtgccgttaagcttgcgcgagacgtcggaagagc

SEQ ID NO: 51436 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcacagcttcagcagcggcctggtgccgttaagcttgcgcgagacgtcggaagagc

SEQ ID NO: 51437 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcacttcagcagcggcctggtgccgttaagcttgcgcgagacgtcggaagagc

SEQ ID NO: 51438 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccacagcagcggcctggtgccgttaagcttgcgcgagacgtcggaagagc

SEQ ID NO: 51439 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccacagcggcctggtgccgttaagcttgcgcgagacgtcggaagagc

SEQ ID NO: 51440 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccacggcctggtgccgttaagcttgcgcgagacgtcggaagagc

SEQ ID NO: 51441 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccacctggtgccgttaagcttgcgcgagacgtcggaagagc

SEQ ID NO: 51442 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccacgtgccgttaagcttgcgcgagacgtcggaagagc

SEQ ID NO: 51443 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcacccgttaagcttgcgcgagacgtcggaagagc

SEQ ID NO: 51444 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcacttaagcttgcgcgagacgtcggaagagc

SEQ ID NO: 51445 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcacagcttgcgcgagacgtcggaagagc

SEQ ID NO: 51446 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacacttgcgcgagacgtcggaagagc

SEQ ID NO: 51447 - RNA, 293 nt, synthetic construct
  source 1..293: mol_type = other RNA
cgctcttccgcgtctcgtcttcctgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51448 - RNA, 293 nt, synthetic construct
  source 1..293: mol_type = other RNA
cgctcttccgcgtctcgtcttcatgctggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51449 - RNA, 293 nt, synthetic construct
  source 1..293: mol_type = other RNA
cgctcttccgcgtctcgtcttcatgaacctgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51450 - RNA, 293 nt, synthetic construct
  source 1..293: mol_type = other RNA
cgctcttccgcgtctcgtcttcatgaacgagctggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51451 - RNA, 293 nt, synthetic construct
  source 1..293: mol_type = other RNA
cgctcttccgcgtctcgtcttcatgaacgagaagctggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51452 - RNA, 293 nt, synthetic construct
  source 1..293: mol_type = other RNA
cgctcttccgcgtctcgtcttcatgaacgagaaggagctgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51453 - RNA, 293 nt, synthetic construct
  source 1..293: mol_type = other RNA
cgctcttccgcgtctcgtcttcatgaacgagaaggaggacctgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51454 - RNA, 293 nt, synthetic construct; identical to SEQ ID NO: 49292
  source 1..293: mol_type = other RNA

SEQ ID NO: 51455 - RNA, 293 nt, synthetic construct
  source 1..293: mol_type = other RNA
cgctcttccgcgtctcgtcttcatgaacgagaaggaggacatcctgctgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51456 - RNA, 293 nt, synthetic construct
  source 1..293: mol_type = other RNA
cgctcttccgcgtctcgtcttcatgaacgagaaggaggacatcctgtggctgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51457 - RNA, 293 nt, synthetic construct
  source 1..293: mol_type = other RNA
cgctcttccgcgtctcgtcttcatgaacgagaaggaggacatcctgtggtgcctggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51458 - RNA, 293 nt, synthetic construct
  source 1..293: mol_type = other RNA
cgctcttccgcgtctcgtcttcatgaacgagaaggaggacatcctgtggtgcactctgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51459 - RNA, 293 nt, synthetic construct
  source 1..293: mol_type = other RNA
cgctcttccgcgtctcgtcttcatgaacgagaaggaggacatcctgtggtgcactgaactggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51460 - RNA, 293 nt, synthetic construct
  source 1..293: mol_type = other RNA
cgctcttccgcgtctcgtcttcatgaacgagaaggaggacatcctgtggtgcactgaaatgctgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51461 - RNA, 293 nt, synthetic construct
  source 1..293: mol_type = other RNA
cgctcttccgcgtctcgtcttcatgaacgagaaggaggacatcctgtggtgcactgaaatggaactggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51462 - RNA, 293 nt, synthetic construct
  source 1..293: mol_type = other RNA
cgctcttccgcgtctcgtcttcatgaacgagaaggaggacatcctgtggtgcactgaaatggaaaggctgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51463 - RNA, 293 nt, synthetic construct
  source 1..293: mol_type = other RNA
cgctcttccgcgtctcgtcttcatgaacgagaaggaggacatcctgtggtgcactgaaatggaaagggtgctgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51464 - RNA, 293 nt, synthetic construct
  source 1..293: mol_type = other RNA
cgctcttccgcgtctcgtcttcatgaacgagaaggaggacatcctgtggtgcactgaaatggaaagggtgtttctgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51465 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcctgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51466 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcctggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51467 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccctgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51468 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcctgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51469 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacctgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51470 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacctggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51471 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacactggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51472 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacctgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51473 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgctgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51474 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccctgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51475 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacctgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51476 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgctgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51477 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcctgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51478 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcctggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51479 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgctgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51480 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgctgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51481 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggctgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51482 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagctgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51483 - RNA, 293 nt, synthetic construct; identical to SEQ ID NO: 49292
  source 1..293: mol_type = other RNA

SEQ ID NO: 51484 - RNA, 293 nt, synthetic construct; identical to SEQ ID NO: 49292
  source 1..293: mol_type = other RNA

SEQ ID NO: 51485 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgctgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51486 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcctgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51487 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggctgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51488 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgctgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51489 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggctggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51490 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcctgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51491 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgctggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51492 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgctgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51493 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcctgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51494 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcctgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51495 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcctgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51496 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51497 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcctggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51498 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcctgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51499 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctctgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51500 - RNA, 293 nt, synthetic construct; identical to SEQ ID NO: 49292
  source 1..293: mol_type = other RNA

SEQ ID NO: 51501 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgctggaatattttgcttgtgtgtctagcggcaatagtaacgctaacagccgcgggccgagcttcagcagcggcctggtgccgttaagcttgcgcgagacgtcggaagagc

SEQ ID NO: 51502 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagctgtattttgcttgtgtgtctagcggcaatagtaacgctaacagccgcgggccgagcttcagcagcggcctggtgccgttaagcttgcgcgagacgtcggaagagc

SEQ ID NO: 51503 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaactgtttgcttgtgtgtctagcggcaatagtaacgctaacagccgcgggccgagcttcagcagcggcctggtgccgttaagcttgcgcgagacgtcggaagagc

SEQ ID NO: 51504 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatctggcttgtgtgtctagcggcaatagtaacgctaacagccgcgggccgagcttcagcagcggcctggtgccgttaagcttgcgcgagacgtcggaagagc

SEQ ID NO: 51505 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttctgtgtgtgtctagcggcaatagtaacgctaacagccgcgggccgagcttcagcagcggcctggtgccgttaagcttgcgcgagacgtcggaagagc

SEQ ID NO: 51506 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctctggtgtctagcggcaatagtaacgctaacagccgcgggccgagcttcagcagcggcctggtgccgttaagcttgcgcgagacgtcggaagagc

SEQ ID NO: 51507 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtctgtctagcggcaatagtaacgctaacagccgcgggccgagcttcagcagcggcctggtgccgttaagcttgcgcgagacgtcggaagagc

SEQ ID NO: 51508 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgctgagcggcaatagtaacgctaacagccgcgggccgagcttcagcagcggcctggtgccgttaagcttgcgcgagacgtcggaagagc

SEQ ID NO: 51509 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctctgggcaatagtaacgctaacagccgcgggccgagcttcagcagcggcctggtgccgttaagcttgcgcgagacgtcggaagagc

SEQ ID NO: 51510 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcctgaatagtaacgctaacagccgcgggccgagcttcagcagcggcctggtgccgttaagcttgcgcgagacgtcggaagagc

SEQ ID NO: 51511 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcctgagtaacgctaacagccgcgggccgagcttcagcagcggcctggtgccgttaagcttgcgcgagacgtcggaagagc

SEQ ID NO: 51512 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatctgaacgctaacagccgcgggccgagcttcagcagcggcctggtgccgttaagcttgcgcgagacgtcggaagagc

SEQ ID NO: 51513 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtctggctaacagccgcgggccgagcttcagcagcggcctggtgccgttaagcttgcgcgagacgtcggaagagc

SEQ ID NO: 51514 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacctgaacagccgcgggccgagcttcagcagcggcctggtgccgttaagcttgcgcgagacgtcggaagagc

SEQ ID NO: 51515 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctctgagccgcgggccgagcttcagcagcggcctggtgccgttaagcttgcgcgagacgtcggaagagc

SEQ ID NO: 51516 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacctgcgcgggccgagcttcagcagcggcctggtgccgttaagcttgcgcgagacgtcggaagagc

SEQ ID NO: 51517 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcctggggccgagcttcagcagcggcctggtgccgttaagcttgcgcgagacgtcggaagagc

SEQ ID NO: 51518 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcctgccgagcttcagcagcggcctggtgccgttaagcttgcgcgagacgtcggaagagc

SEQ ID NO: 51519 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggctgagcttcagcagcggcctggtgccgttaagcttgcgcgagacgtcggaagagc

SEQ ID NO: 51520 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgctgttcagcagcggcctggtgccgttaagcttgcgcgagacgtcggaagagc

SEQ ID NO: 51521 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcctgagcagcggcctggtgccgttaagcttgcgcgagacgtcggaagagc

SEQ ID NO: 51522 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcctgagcggcctggtgccgttaagcttgcgcgagacgtcggaagagc

SEQ ID NO: 51523 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcctgggcctggtgccgttaagcttgcgcgagacgtcggaagagc

SEQ ID NO: 51524 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcctgctggtgccgttaagcttgcgcgagacgtcggaagagc

SEQ ID NO: 51525 - RNA, 293 nt, synthetic construct; identical to SEQ ID NO: 49292
  source 1..293: mol_type = other RNA

SEQ ID NO: 51526 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgctgccgttaagcttgcgcgagacgtcggaagagc

SEQ ID NO: 51527 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgctgttaagcttgcgcgagacgtcggaagagc

SEQ ID NO: 51528 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgctgagcttgcgcgagacgtcggaagagc

SEQ ID NO: 51529 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttactgttgcgcgagacgtcggaagagc

SEQ ID NO: 51530 - RNA, 293 nt, synthetic construct
  source 1..293: mol_type = other RNA
cgctcttccgcgtctcgtcttcctcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51531 - RNA, 293 nt, synthetic construct
  source 1..293: mol_type = other RNA
cgctcttccgcgtctcgtcttcatgctcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51532 - RNA, 293 nt, synthetic construct
  source 1..293: mol_type = other RNA
cgctcttccgcgtctcgtcttcatgaacctcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51533 - RNA, 293 nt, synthetic construct
  source 1..293: mol_type = other RNA
cgctcttccgcgtctcgtcttcatgaacgagctcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51534 - RNA, 293 nt, synthetic construct
  source 1..293: mol_type = other RNA
cgctcttccgcgtctcgtcttcatgaacgagaagctcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51535 - RNA, 293 nt, synthetic construct
  source 1..293: mol_type = other RNA
cgctcttccgcgtctcgtcttcatgaacgagaaggagctcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51536 - RNA, 293 nt, synthetic construct
  source 1..293: mol_type = other RNA
cgctcttccgcgtctcgtcttcatgaacgagaaggaggacctcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51537 - RNA, 293 nt, synthetic construct
  source 1..293: mol_type = other RNA
cgctcttccgcgtctcgtcttcatgaacgagaaggaggacatcctctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51538 - RNA, 293 nt, synthetic construct
  source 1..293: mol_type = other RNA
cgctcttccgcgtctcgtcttcatgaacgagaaggaggacatcctgctctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51539 - RNA, 293 nt, synthetic construct
  source 1..293: mol_type = other RNA
cgctcttccgcgtctcgtcttcatgaacgagaaggaggacatcctgtggctcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51540 - RNA, 293 nt, synthetic construct
  source 1..293: mol_type = other RNA
cgctcttccgcgtctcgtcttcatgaacgagaaggaggacatcctgtggtgcctcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51541 - RNA, 293 nt, synthetic construct
  source 1..293: mol_type = other RNA
cgctcttccgcgtctcgtcttcatgaacgagaaggaggacatcctgtggtgcactctcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51542 - RNA, 293 nt, synthetic construct
  source 1..293: mol_type = other RNA
cgctcttccgcgtctcgtcttcatgaacgagaaggaggacatcctgtggtgcactgaactcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51543 - RNA, 293 nt, synthetic construct
  source 1..293: mol_type = other RNA
cgctcttccgcgtctcgtcttcatgaacgagaaggaggacatcctgtggtgcactgaaatgctcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51544 - RNA, 293 nt, synthetic construct
  source 1..293: mol_type = other RNA
cgctcttccgcgtctcgtcttcatgaacgagaaggaggacatcctgtggtgcactgaaatggaactcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51545 - RNA, 293 nt, synthetic construct
  source 1..293: mol_type = other RNA
cgctcttccgcgtctcgtcttcatgaacgagaaggaggacatcctgtggtgcactgaaatggaaaggctctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51546 - RNA, 293 nt, synthetic construct
  source 1..293: mol_type = other RNA
cgctcttccgcgtctcgtcttcatgaacgagaaggaggacatcctgtggtgcactgaaatggaaagggtgctcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51547 - RNA, 293 nt, synthetic construct
  source 1..293: mol_type = other RNA
cgctcttccgcgtctcgtcttcatgaacgagaaggaggacatcctgtggtgcactgaaatggaaagggtgtttctcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51548 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcctccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51549 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcctcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51550 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccctccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51551 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcctctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51552 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacctcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51553 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacctcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51554 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacactcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51555 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacctctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51556 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgctcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51557 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccctcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51558 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacctcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51559 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgctccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51560 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcctcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51561 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcctcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51562 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgctcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51563 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgctccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51564 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggctcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51565 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagctcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51566 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51567 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51568 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgctccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51569 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcctctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51570 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggctctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51571 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgctcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51572 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggctcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51573 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcctcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51574 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgctcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51575 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgctcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51576 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcctccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51577 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcctccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51578 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcctcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51579 - RNA, 293 nt, synthetic construct; identical to SEQ ID NO: 49292
  source 1..293: mol_type = other RNA

SEQ ID NO: 51580 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcctcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51581 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcctcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51582 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctctcctgaaggaatattttgcttgtgtgtctagcggcaatagtaacgctaacagccgcgggccgagcttcagcagcggcctggtgccgttaagcttgcgcgagacgtcggaagagc

SEQ ID NO: 51583 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctcaaggaatattttgcttgtgtgtctagcggcaatagtaacgctaacagccgcgggccgagcttcagcagcggcctggtgccgttaagcttgcgcgagacgtcggaagagc

SEQ ID NO: 51584 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgctcgaatattttgcttgtgtgtctagcggcaatagtaacgctaacagccgcgggccgagcttcagcagcggcctggtgccgttaagcttgcgcgagacgtcggaagagc

SEQ ID NO: 51585 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagctctattttgcttgtgtgtctagcggcaatagtaacgctaacagccgcgggccgagcttcagcagcggcctggtgccgttaagcttgcgcgagacgtcggaagagc

SEQ ID NO: 51586 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaactctttgcttgtgtgtctagcggcaatagtaacgctaacagccgcgggccgagcttcagcagcggcctggtgccgttaagcttgcgcgagacgtcggaagagc

SEQ ID NO: 51587 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatctcgcttgtgtgtctagcggcaatagtaacgctaacagccgcgggccgagcttcagcagcggcctggtgccgttaagcttgcgcgagacgtcggaagagc

SEQ ID NO: 51588 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttctctgtgtgtctagcggcaatagtaacgctaacagccgcgggccgagcttcagcagcggcctggtgccgttaagcttgcgcgagacgtcggaagagc

SEQ ID NO: 51589 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctctcgtgtctagcggcaatagtaacgctaacagccgcgggccgagcttcagcagcggcctggtgccgttaagcttgcgcgagacgtcggaagagc

SEQ ID NO: 51590 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtctctctagcggcaatagtaacgctaacagccgcgggccgagcttcagcagcggcctggtgccgttaagcttgcgcgagacgtcggaagagc

SEQ ID NO: 51591 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgctcagcggcaatagtaacgctaacagccgcgggccgagcttcagcagcggcctggtgccgttaagcttgcgcgagacgtcggaagagc

SEQ ID NO: 51592 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctctcggcaatagtaacgctaacagccgcgggccgagcttcagcagcggcctggtgccgttaagcttgcgcgagacgtcggaagagc

SEQ ID NO: 51593 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcctcaatagtaacgctaacagccgcgggccgagcttcagcagcggcctggtgccgttaagcttgcgcgagacgtcggaagagc

SEQ ID NO: 51594 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcctcagtaacgctaacagccgcgggccgagcttcagcagcggcctggtgccgttaagcttgcgcgagacgtcggaagagc

SEQ ID NO: 51595 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatctcaacgctaacagccgcgggccgagcttcagcagcggcctggtgccgttaagcttgcgcgagacgtcggaagagc

SEQ ID NO: 51596 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtctcgctaacagccgcgggccgagcttcagcagcggcctggtgccgttaagcttgcgcgagacgtcggaagagc

SEQ ID NO: 51597 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacctcaacagccgcgggccgagcttcagcagcggcctggtgccgttaagcttgcgcgagacgtcggaagagc

SEQ ID NO: 51598 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctctcagccgcgggccgagcttcagcagcggcctggtgccgttaagcttgcgcgagacgtcggaagagc

SEQ ID NO: 51599 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacctccgcgggccgagcttcagcagcggcctggtgccgttaagcttgcgcgagacgtcggaagagc

SEQ ID NO: 51600 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcctcgggccgagcttcagcagcggcctggtgccgttaagcttgcgcgagacgtcggaagagc

SEQ ID NO: 51601 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcctcccgagcttcagcagcggcctggtgccgttaagcttgcgcgagacgtcggaagagc

SEQ ID NO: 51602 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggctcagcttcagcagcggcctggtgccgttaagcttgcgcgagacgtcggaagagc

SEQ ID NO: 51603 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgctcttcagcagcggcctggtgccgttaagcttgcgcgagacgtcggaagagc

SEQ ID NO: 51604 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcctcagcagcggcctggtgccgttaagcttgcgcgagacgtcggaagagc

SEQ ID NO: 51605 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcctcagcggcctggtgccgttaagcttgcgcgagacgtcggaagagc

SEQ ID NO: 51606 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcctcggcctggtgccgttaagcttgcgcgagacgtcggaagagc

SEQ ID NO: 51607 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcctcctggtgccgttaagcttgcgcgagacgtcggaagagc

SEQ ID NO: 51608 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctcgtgccgttaagcttgcgcgagacgtcggaagagc

SEQ ID NO: 51609 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgctcccgttaagcttgcgcgagacgtcggaagagc

SEQ ID NO: 51610 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgctcttaagcttgcgcgagacgtcggaagagc

SEQ ID NO: 51611 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgctcagcttgcgcgagacgtcggaagagc

SEQ ID NO: 51612 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttactcttgcgcgagacgtcggaagagc

SEQ ID NO: 51613 - RNA, 293 nt, synthetic construct
  source 1..293: mol_type = other RNA
cgctcttccgcgtctcgtcttccggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51614 - RNA, 293 nt, synthetic construct
  source 1..293: mol_type = other RNA
cgctcttccgcgtctcgtcttcatgcgggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51615 - RNA, 293 nt, synthetic construct
  source 1..293: mol_type = other RNA
cgctcttccgcgtctcgtcttcatgaaccggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51616 - RNA, 293 nt, synthetic construct
  source 1..293: mol_type = other RNA
cgctcttccgcgtctcgtcttcatgaacgagcgggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51617 - RNA, 293 nt, synthetic construct
  source 1..293: mol_type = other RNA
cgctcttccgcgtctcgtcttcatgaacgagaagcgggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51618 - RNA, 293 nt, synthetic construct
  source 1..293: mol_type = other RNA
cgctcttccgcgtctcgtcttcatgaacgagaaggagcggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51619 - RNA, 293 nt, synthetic construct
  source 1..293: mol_type = other RNA
cgctcttccgcgtctcgtcttcatgaacgagaaggaggaccggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51620 - RNA, 293 nt, synthetic construct
  source 1..293: mol_type = other RNA
cgctcttccgcgtctcgtcttcatgaacgagaaggaggacatccggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51621 - RNA, 293 nt, synthetic construct
  source 1..293: mol_type = other RNA
cgctcttccgcgtctcgtcttcatgaacgagaaggaggacatcctgcggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51622 - RNA, 293 nt, synthetic construct
  source 1..293: mol_type = other RNA
cgctcttccgcgtctcgtcttcatgaacgagaaggaggacatcctgtggcggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51623 - RNA, 293 nt, synthetic construct
  source 1..293: mol_type = other RNA
cgctcttccgcgtctcgtcttcatgaacgagaaggaggacatcctgtggtgccgggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51624 - RNA, 293 nt, synthetic construct
  source 1..293: mol_type = other RNA
cgctcttccgcgtctcgtcttcatgaacgagaaggaggacatcctgtggtgcactcggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51625 - RNA, 293 nt, synthetic construct
  source 1..293: mol_type = other RNA
cgctcttccgcgtctcgtcttcatgaacgagaaggaggacatcctgtggtgcactgaacgggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51626 - RNA, 293 nt, synthetic construct
  source 1..293: mol_type = other RNA
cgctcttccgcgtctcgtcttcatgaacgagaaggaggacatcctgtggtgcactgaaatgcggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51627 - RNA, 293 nt, synthetic construct
  source 1..293: mol_type = other RNA
cgctcttccgcgtctcgtcttcatgaacgagaaggaggacatcctgtggtgcactgaaatggaacgggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51628 - RNA, 293 nt, synthetic construct
  source 1..293: mol_type = other RNA
cgctcttccgcgtctcgtcttcatgaacgagaaggaggacatcctgtggtgcactgaaatggaaaggcggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51629 - RNA, 293 nt, synthetic construct
  source 1..293: mol_type = other RNA
cgctcttccgcgtctcgtcttcatgaacgagaaggaggacatcctgtggtgcactgaaatggaaagggtgcggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51630 - RNA, 293 nt, synthetic construct
  source 1..293: mol_type = other RNA
cgctcttccgcgtctcgtcttcatgaacgagaaggaggacatcctgtggtgcactgaaatggaaagggtgtttcggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51631 - RNA, 293 nt, synthetic construct
  source 1..293: mol_type = other RNA
cgctcttccgcgtctcgtcttcatgaacgagaaggaggacatcctgtggtgcactgaaatggaaagggtgtttggccggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51632 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccgggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51633 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccccggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51634 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51635 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccaccggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51636 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactaccgggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51637 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacacgggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51638 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagaccggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51639 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgcggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51640 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcccggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51641 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaaccggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51642 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgcggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51643 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51644 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgccgggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51645 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51646 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51647 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51648 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51649 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51650 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51651 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51652 - RNA, 293 nt, synthetic construct; identical to SEQ ID NO: 49292
  source 1..293: mol_type = other RNA

SEQ ID NO: 51653 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51654 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51655 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcgggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51656 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51657 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcgggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51658 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51659 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51660 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51661 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51662 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51663 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccgggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51664 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51665 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcggctgaaggaatattttgcttgtgtgtctagcggcaatagtaacgctaacagccgcgggccgagcttcagcagcggcctggtgccgttaagcttgcgcgagacgtcggaagagc

SEQ ID NO: 51666 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcggaaggaatattttgcttgtgtgtctagcggcaatagtaacgctaacagccgcgggccgagcttcagcagcggcctggtgccgttaagcttgcgcgagacgtcggaagagc

SEQ ID NO: 51667 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcgggaatattttgcttgtgtgtctagcggcaatagtaacgctaacagccgcgggccgagcttcagcagcggcctggtgccgttaagcttgcgcgagacgtcggaagagc

SEQ ID NO: 51668 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcggtattttgcttgtgtgtctagcggcaatagtaacgctaacagccgcgggccgagcttcagcagcggcctggtgccgttaagcttgcgcgagacgtcggaagagc

SEQ ID NO: 51669 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacggtttgcttgtgtgtctagcggcaatagtaacgctaacagccgcgggccgagcttcagcagcggcctggtgccgttaagcttgcgcgagacgtcggaagagc

SEQ ID NO: 51670 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcgggcttgtgtgtctagcggcaatagtaacgctaacagccgcgggccgagcttcagcagcggcctggtgccgttaagcttgcgcgagacgtcggaagagc

SEQ ID NO: 51671 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcggtgtgtgtctagcggcaatagtaacgctaacagccgcgggccgagcttcagcagcggcctggtgccgttaagcttgcgcgagacgtcggaagagc

SEQ ID NO: 51672 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcgggtgtctagcggcaatagtaacgctaacagccgcgggccgagcttcagcagcggcctggtgccgttaagcttgcgcgagacgtcggaagagc

SEQ ID NO: 51673 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcggtctagcggcaatagtaacgctaacagccgcgggccgagcttcagcagcggcctggtgccgttaagcttgcgcgagacgtcggaagagc

SEQ ID NO: 51674 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcggagcggcaatagtaacgctaacagccgcgggccgagcttcagcagcggcctggtgccgttaagcttgcgcgagacgtcggaagagc

SEQ ID NO: 51675 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcggggcaatagtaacgctaacagccgcgggccgagcttcagcagcggcctggtgccgttaagcttgcgcgagacgtcggaagagc

SEQ ID NO: 51676 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccggaatagtaacgctaacagccgcgggccgagcttcagcagcggcctggtgccgttaagcttgcgcgagacgtcggaagagc

SEQ ID NO: 51677 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccggagtaacgctaacagccgcgggccgagcttcagcagcggcctggtgccgttaagcttgcgcgagacgtcggaagagc

SEQ ID NO: 51678 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcggaacgctaacagccgcgggccgagcttcagcagcggcctggtgccgttaagcttgcgcgagacgtcggaagagc

SEQ ID NO: 51679 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcgggctaacagccgcgggccgagcttcagcagcggcctggtgccgttaagcttgcgcgagacgtcggaagagc

SEQ ID NO: 51680 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccggaacagccgcgggccgagcttcagcagcggcctggtgccgttaagcttgcgcgagacgtcggaagagc

SEQ ID NO: 51681 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcggagccgcgggccgagcttcagcagcggcctggtgccgttaagcttgcgcgagacgtcggaagagc

SEQ ID NO: 51682 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccggcgcgggccgagcttcagcagcggcctggtgccgttaagcttgcgcgagacgtcggaagagc

SEQ ID NO: 51683 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgggggccgagcttcagcagcggcctggtgccgttaagcttgcgcgagacgtcggaagagc

SEQ ID NO: 51684 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccggccgagcttcagcagcggcctggtgccgttaagcttgcgcgagacgtcggaagagc

SEQ ID NO: 51685 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcggagcttcagcagcggcctggtgccgttaagcttgcgcgagacgtcggaagagc

SEQ ID NO: 51686 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcggttcagcagcggcctggtgccgttaagcttgcgcgagacgtcggaagagc

SEQ ID NO: 51687 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccggagcagcggcctggtgccgttaagcttgcgcgagacgtcggaagagc

SEQ ID NO: 51688 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccggagcggcctggtgccgttaagcttgcgcgagacgtcggaagagc

SEQ ID NO: 51689 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccggggcctggtgccgttaagcttgcgcgagacgtcggaagagc

SEQ ID NO: 51690 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccggctggtgccgttaagcttgcgcgagacgtcggaagagc

SEQ ID NO: 51691 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccgggtgccgttaagcttgcgcgagacgtcggaagagc

SEQ ID NO: 51692 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcggccgttaagcttgcgcgagacgtcggaagagc

SEQ ID NO: 51693 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcggttaagcttgcgcgagacgtcggaagagc

SEQ ID NO: 51694 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcggagcttgcgcgagacgtcggaagagc

SEQ ID NO: 51695 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacggttgcgcgagacgtcggaagagc

SEQ ID NO: 51696 - RNA, 293 nt, synthetic construct
  source 1..293: mol_type = other RNA
cgctcttccgcgtctcgtcttccgcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51697 - RNA, 293 nt, synthetic construct
  source 1..293: mol_type = other RNA
cgctcttccgcgtctcgtcttcatgcgcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51698 - RNA, 293 nt, synthetic construct
  source 1..293: mol_type = other RNA
cgctcttccgcgtctcgtcttcatgaaccgcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51699 - RNA, 293 nt, synthetic construct
  source 1..293: mol_type = other RNA
cgctcttccgcgtctcgtcttcatgaacgagcgcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51700 - RNA, 293 nt, synthetic construct
  source 1..293: mol_type = other RNA
cgctcttccgcgtctcgtcttcatgaacgagaagcgcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51701 - RNA, 293 nt, synthetic construct
  source 1..293: mol_type = other RNA
cgctcttccgcgtctcgtcttcatgaacgagaaggagcgcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51702 - RNA, 293 nt, synthetic construct
  source 1..293: mol_type = other RNA
cgctcttccgcgtctcgtcttcatgaacgagaaggaggaccgcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51703 - RNA, 293 nt, synthetic construct
  source 1..293: mol_type = other RNA
cgctcttccgcgtctcgtcttcatgaacgagaaggaggacatccgctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51704 - RNA, 293 nt, synthetic construct
  source 1..293: mol_type = other RNA
cgctcttccgcgtctcgtcttcatgaacgagaaggaggacatcctgcgctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51705 - RNA, 293 nt, synthetic construct
  source 1..293: mol_type = other RNA
cgctcttccgcgtctcgtcttcatgaacgagaaggaggacatcctgtggcgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51706 - RNA, 293 nt, synthetic construct
  source 1..293: mol_type = other RNA
cgctcttccgcgtctcgtcttcatgaacgagaaggaggacatcctgtggtgccgcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51707 - RNA, 293 nt, synthetic construct
  source 1..293: mol_type = other RNA
cgctcttccgcgtctcgtcttcatgaacgagaaggaggacatcctgtggtgcactcgcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51708 - RNA, 293 nt, synthetic construct
  source 1..293: mol_type = other RNA
cgctcttccgcgtctcgtcttcatgaacgagaaggaggacatcctgtggtgcactgaacgcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51709 - RNA, 293 nt, synthetic construct
  source 1..293: mol_type = other RNA
cgctcttccgcgtctcgtcttcatgaacgagaaggaggacatcctgtggtgcactgaaatgcgcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51710 - RNA, 293 nt, synthetic construct
  source 1..293: mol_type = other RNA
cgctcttccgcgtctcgtcttcatgaacgagaaggaggacatcctgtggtgcactgaaatggaacgcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51711 - RNA, 293 nt, synthetic construct
  source 1..293: mol_type = other RNA
cgctcttccgcgtctcgtcttcatgaacgagaaggaggacatcctgtggtgcactgaaatggaaaggcgctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51712 - RNA, 293 nt, synthetic construct
  source 1..293: mol_type = other RNA
cgctcttccgcgtctcgtcttcatgaacgagaaggaggacatcctgtggtgcactgaaatggaaagggtgcgcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51713 - RNA, 293 nt, synthetic construct
  source 1..293: mol_type = other RNA
cgctcttccgcgtctcgtcttcatgaacgagaaggaggacatcctgtggtgcactgaaatggaaagggtgtttcgcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51714 - RNA, 293 nt, synthetic construct
  source 1..293: mol_type = other RNA
cgctcttccgcgtctcgtcttcatgaacgagaaggaggacatcctgtggtgcactgaaatggaaagggtgtttggccgccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51715 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccgcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51716 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccccgccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51717 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccgctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51718 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccaccgcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51719 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactaccgcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51720 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacacgcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51721 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagaccgctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51722 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgcgcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51723 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcccgcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51724 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaaccgcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51725 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgcgccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51726 - RNA, 293 nt, synthetic construct; identical to SEQ ID NO: 49292
  source 1..293: mol_type = other RNA

SEQ ID NO: 51727 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgccgcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51728 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcgcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51729 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcgccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51730 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcgcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51731 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcgcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51732 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacgcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51733 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcgcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51734 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcgccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51735 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51736 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcgctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51737 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcgcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51738 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcgcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51739 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccgcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51740 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcgcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51741 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcgcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51742 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccgccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51743 - RNA, 293 nt, synthetic construct; identical to SEQ ID NO: 49292
  source 1..293: mol_type = other RNA

SEQ ID NO: 51744 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccgcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51745 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccgcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51746 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccgcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51747 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccgcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51748 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcgcctgaaggaatattttgcttgtgtgtctagcggcaatagtaacgctaacagccgcgggccgagcttcagcagcggcctggtgccgttaagcttgcgcgagacgtcggaagagc

SEQ ID NO: 51749 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcgcaaggaatattttgcttgtgtgtctagcggcaatagtaacgctaacagccgcgggccgagcttcagcagcggcctggtgccgttaagcttgcgcgagacgtcggaagagc

SEQ ID NO: 51750 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcgcgaatattttgcttgtgtgtctagcggcaatagtaacgctaacagccgcgggccgagcttcagcagcggcctggtgccgttaagcttgcgcgagacgtcggaagagc

SEQ ID NO: 51751 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcgctattttgcttgtgtgtctagcggcaatagtaacgctaacagccgcgggccgagcttcagcagcggcctggtgccgttaagcttgcgcgagacgtcggaagagc

SEQ ID NO: 51752 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacgctttgcttgtgtgtctagcggcaatagtaacgctaacagccgcgggccgagcttcagcagcggcctggtgccgttaagcttgcgcgagacgtcggaagagc

SEQ ID NO: 51753 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcgcgcttgtgtgtctagcggcaatagtaacgctaacagccgcgggccgagcttcagcagcggcctggtgccgttaagcttgcgcgagacgtcggaagagc

SEQ ID NO: 51754 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcgctgtgtgtctagcggcaatagtaacgctaacagccgcgggccgagcttcagcagcggcctggtgccgttaagcttgcgcgagacgtcggaagagc

SEQ ID NO: 51755 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcgcgtgtctagcggcaatagtaacgctaacagccgcgggccgagcttcagcagcggcctggtgccgttaagcttgcgcgagacgtcggaagagc

SEQ ID NO: 51756 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcgctctagcggcaatagtaacgctaacagccgcgggccgagcttcagcagcggcctggtgccgttaagcttgcgcgagacgtcggaagagc

SEQ ID NO: 51757 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcgcagcggcaatagtaacgctaacagccgcgggccgagcttcagcagcggcctggtgccgttaagcttgcgcgagacgtcggaagagc

SEQ ID NO: 51758 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcgcggcaatagtaacgctaacagccgcgggccgagcttcagcagcggcctggtgccgttaagcttgcgcgagacgtcggaagagc

SEQ ID NO: 51759 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccgcaatagtaacgctaacagccgcgggccgagcttcagcagcggcctggtgccgttaagcttgcgcgagacgtcggaagagc

SEQ ID NO: 51760 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccgcagtaacgctaacagccgcgggccgagcttcagcagcggcctggtgccgttaagcttgcgcgagacgtcggaagagc

SEQ ID NO: 51761 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcgcaacgctaacagccgcgggccgagcttcagcagcggcctggtgccgttaagcttgcgcgagacgtcggaagagc

SEQ ID NO: 51762 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcgcgctaacagccgcgggccgagcttcagcagcggcctggtgccgttaagcttgcgcgagacgtcggaagagc

SEQ ID NO: 51763 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccgcaacagccgcgggccgagcttcagcagcggcctggtgccgttaagcttgcgcgagacgtcggaagagc

SEQ ID NO: 51764 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcgcagccgcgggccgagcttcagcagcggcctggtgccgttaagcttgcgcgagacgtcggaagagc

SEQ ID NO: 51765 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccgccgcgggccgagcttcagcagcggcctggtgccgttaagcttgcgcgagacgtcggaagagc

SEQ ID NO: 51766 - RNA, 293 nt, synthetic construct; identical to SEQ ID NO: 49292
  source 1..293: mol_type = other RNA

SEQ ID NO: 51767 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccgcccgagcttcagcagcggcctggtgccgttaagcttgcgcgagacgtcggaagagc

SEQ ID NO: 51768 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcgcagcttcagcagcggcctggtgccgttaagcttgcgcgagacgtcggaagagc

SEQ ID NO: 51769 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcgcttcagcagcggcctggtgccgttaagcttgcgcgagacgtcggaagagc

SEQ ID NO: 51770 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccgcagcagcggcctggtgccgttaagcttgcgcgagacgtcggaagagc

SEQ ID NO: 51771 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccgcagcggcctggtgccgttaagcttgcgcgagacgtcggaagagc

SEQ ID NO: 51772 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccgcggcctggtgccgttaagcttgcgcgagacgtcggaagagc

SEQ ID NO: 51773 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccgcctggtgccgttaagcttgcgcgagacgtcggaagagc

SEQ ID NO: 51774 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccgcgtgccgttaagcttgcgcgagacgtcggaagagc

SEQ ID NO: 51775 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcgcccgttaagcttgcgcgagacgtcggaagagc

SEQ ID NO: 51776 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcgcttaagcttgcgcgagacgtcggaagagc

SEQ ID NO: 51777 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcgcagcttgcgcgagacgtcggaagagc

SEQ ID NO: 51778 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacgcttgcgcgagacgtcggaagagc

SEQ ID NO: 51779 - RNA, 293 nt, synthetic construct
  source 1..293: mol_type = other RNA
cgctcttccgcgtctcgtcttcccgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51780 - RNA, 293 nt, synthetic construct
  source 1..293: mol_type = other RNA
cgctcttccgcgtctcgtcttcatgccggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51781 - RNA, 293 nt, synthetic construct
  source 1..293: mol_type = other RNA
cgctcttccgcgtctcgtcttcatgaacccgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51782 - RNA, 293 nt, synthetic construct
  source 1..293: mol_type = other RNA
cgctcttccgcgtctcgtcttcatgaacgagccggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51783 - RNA, 293 nt, synthetic construct
  source 1..293: mol_type = other RNA
cgctcttccgcgtctcgtcttcatgaacgagaagccggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51784 - RNA, 293 nt, synthetic construct
  source 1..293: mol_type = other RNA
cgctcttccgcgtctcgtcttcatgaacgagaaggagccgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51785 - RNA, 293 nt, synthetic construct
  source 1..293: mol_type = other RNA
cgctcttccgcgtctcgtcttcatgaacgagaaggaggacccgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51786 - RNA, 293 nt, synthetic construct
  source 1..293: mol_type = other RNA
cgctcttccgcgtctcgtcttcatgaacgagaaggaggacatcccgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51787 - RNA, 293 nt, synthetic construct
  source 1..293: mol_type = other RNA
cgctcttccgcgtctcgtcttcatgaacgagaaggaggacatcctgccgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51788 - RNA, 293 nt, synthetic construct
  source 1..293: mol_type = other RNA
cgctcttccgcgtctcgtcttcatgaacgagaaggaggacatcctgtggccgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51789 - RNA, 293 nt, synthetic construct
  source 1..293: mol_type = other RNA
cgctcttccgcgtctcgtcttcatgaacgagaaggaggacatcctgtggtgcccggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51790 - RNA, 293 nt, synthetic construct
  source 1..293: mol_type = other RNA
cgctcttccgcgtctcgtcttcatgaacgagaaggaggacatcctgtggtgcactccgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51791 - RNA, 293 nt, synthetic construct
  source 1..293: mol_type = other RNA
cgctcttccgcgtctcgtcttcatgaacgagaaggaggacatcctgtggtgcactgaaccggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51792 - RNA, 293 nt, synthetic construct
  source 1..293: mol_type = other RNA
cgctcttccgcgtctcgtcttcatgaacgagaaggaggacatcctgtggtgcactgaaatgccgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51793 - RNA, 293 nt, synthetic construct
  source 1..293: mol_type = other RNA
cgctcttccgcgtctcgtcttcatgaacgagaaggaggacatcctgtggtgcactgaaatggaaccggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51794 - RNA, 293 nt, synthetic construct
  source 1..293: mol_type = other RNA
cgctcttccgcgtctcgtcttcatgaacgagaaggaggacatcctgtggtgcactgaaatggaaaggccgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51795 - RNA, 293 nt, synthetic construct
  source 1..293: mol_type = other RNA
cgctcttccgcgtctcgtcttcatgaacgagaaggaggacatcctgtggtgcactgaaatggaaagggtgccgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51796 - RNA, 293 nt, synthetic construct
  source 1..293: mol_type = other RNA
cgctcttccgcgtctcgtcttcatgaacgagaaggaggacatcctgtggtgcactgaaatggaaagggtgtttccgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51797 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcccgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51798 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttcccggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51799 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccccgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51800 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcccgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51801 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccacccgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51802 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacccggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51803 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacaccggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51804 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacccgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51805 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgccgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51806 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccccgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51807 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacccgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51808 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgccgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51809 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagcccgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51810 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcccggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51811 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgccgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51812 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgccgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51813 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggccgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51814 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagccgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51815 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaccgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51816 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgccgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51817 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgccgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51818 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcccgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51819 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggccgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51820 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgccgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51821 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggccggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51822 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcccgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51823 - RNA, 293 nt, synthetic construct; identical to SEQ ID NO: 49292
  source 1..293: mol_type = other RNA

SEQ ID NO: 51824 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgccgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51825 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcccgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51826 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcccgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51827 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcccgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51828 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacccgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51829 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcccggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51830 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcccgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51831 - RNA, 293 nt, synthetic construct; identical to SEQ ID NO: 49292
  source 1..293: mol_type = other RNA

SEQ ID NO: 51832 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgccgaaggaatattttgcttgtgtgtctagcggcaatagtaacgctaacagccgcgggccgagcttcagcagcggcctggtgccgttaagcttgcgcgagacgtcggaagagc

SEQ ID NO: 51833 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgccggaatattttgcttgtgtgtctagcggcaatagtaacgctaacagccgcgggccgagcttcagcagcggcctggtgccgttaagcttgcgcgagacgtcggaagagc

SEQ ID NO: 51834 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagccgtattttgcttgtgtgtctagcggcaatagtaacgctaacagccgcgggccgagcttcagcagcggcctggtgccgttaagcttgcgcgagacgtcggaagagc

SEQ ID NO: 51835 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaccgtttgcttgtgtgtctagcggcaatagtaacgctaacagccgcgggccgagcttcagcagcggcctggtgccgttaagcttgcgcgagacgtcggaagagc

SEQ ID NO: 51836 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatccggcttgtgtgtctagcggcaatagtaacgctaacagccgcgggccgagcttcagcagcggcctggtgccgttaagcttgcgcgagacgtcggaagagc

SEQ ID NO: 51837 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttccgtgtgtgtctagcggcaatagtaacgctaacagccgcgggccgagcttcagcagcggcctggtgccgttaagcttgcgcgagacgtcggaagagc

SEQ ID NO: 51838 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctccggtgtctagcggcaatagtaacgctaacagccgcgggccgagcttcagcagcggcctggtgccgttaagcttgcgcgagacgtcggaagagc

SEQ ID NO: 51839 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtccgtctagcggcaatagtaacgctaacagccgcgggccgagcttcagcagcggcctggtgccgttaagcttgcgcgagacgtcggaagagc

SEQ ID NO: 51840 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgccgagcggcaatagtaacgctaacagccgcgggccgagcttcagcagcggcctggtgccgttaagcttgcgcgagacgtcggaagagc

SEQ ID NO: 51841 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctccgggcaatagtaacgctaacagccgcgggccgagcttcagcagcggcctggtgccgttaagcttgcgcgagacgtcggaagagc

SEQ ID NO: 51842 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcccgaatagtaacgctaacagccgcgggccgagcttcagcagcggcctggtgccgttaagcttgcgcgagacgtcggaagagc

SEQ ID NO: 51843 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcccgagtaacgctaacagccgcgggccgagcttcagcagcggcctggtgccgttaagcttgcgcgagacgtcggaagagc

SEQ ID NO: 51844 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatccgaacgctaacagccgcgggccgagcttcagcagcggcctggtgccgttaagcttgcgcgagacgtcggaagagc

SEQ ID NO: 51845 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtccggctaacagccgcgggccgagcttcagcagcggcctggtgccgttaagcttgcgcgagacgtcggaagagc

SEQ ID NO: 51846 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacccgaacagccgcgggccgagcttcagcagcggcctggtgccgttaagcttgcgcgagacgtcggaagagc

SEQ ID NO: 51847 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctccgagccgcgggccgagcttcagcagcggcctggtgccgttaagcttgcgcgagacgtcggaagagc

SEQ ID NO: 51848 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacccgcgcgggccgagcttcagcagcggcctggtgccgttaagcttgcgcgagacgtcggaagagc

SEQ ID NO: 51849 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcccggggccgagcttcagcagcggcctggtgccgttaagcttgcgcgagacgtcggaagagc

SEQ ID NO: 51850 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcccgccgagcttcagcagcggcctggtgccgttaagcttgcgcgagacgtcggaagagc

SEQ ID NO: 51851 - RNA, 293 nt, synthetic construct; identical to SEQ ID NO: 49292
  source 1..293: mol_type = other RNA

SEQ ID NO: 51852 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgccgttcagcagcggcctggtgccgttaagcttgcgcgagacgtcggaagagc

SEQ ID NO: 51853 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcccgagcagcggcctggtgccgttaagcttgcgcgagacgtcggaagagc

SEQ ID NO: 51854 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcccgagcggcctggtgccgttaagcttgcgcgagacgtcggaagagc

SEQ ID NO: 51855 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcccgggcctggtgccgttaagcttgcgcgagacgtcggaagagc

SEQ ID NO: 51856 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcccgctggtgccgttaagcttgcgcgagacgtcggaagagc

SEQ ID NO: 51857 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcccggtgccgttaagcttgcgcgagacgtcggaagagc

SEQ ID NO: 51858 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgccgccgttaagcttgcgcgagacgtcggaagagc

SEQ ID NO: 51859 - RNA, 293 nt, synthetic construct; identical to SEQ ID NO: 49292
  source 1..293: mol_type = other RNA

SEQ ID NO: 51860 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgccgagcttgcgcgagacgtcggaagagc

SEQ ID NO: 51861 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaccgttgcgcgagacgtcggaagagc

SEQ ID NO: 51862 - RNA, 293 nt, synthetic construct
  source 1..293: mol_type = other RNA
cgctcttccgcgtctcgtcttccccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51863 - RNA, 293 nt, synthetic construct
  source 1..293: mol_type = other RNA
cgctcttccgcgtctcgtcttcatgcccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51864 - RNA, 293 nt, synthetic construct
  source 1..293: mol_type = other RNA
cgctcttccgcgtctcgtcttcatgaaccccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51865 - RNA, 293 nt, synthetic construct
  source 1..293: mol_type = other RNA
cgctcttccgcgtctcgtcttcatgaacgagcccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51866 - RNA, 293 nt, synthetic construct
  source 1..293: mol_type = other RNA
cgctcttccgcgtctcgtcttcatgaacgagaagcccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51867 - RNA, 293 nt, synthetic construct
  source 1..293: mol_type = other RNA
cgctcttccgcgtctcgtcttcatgaacgagaaggagcccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51868 - RNA, 293 nt, synthetic construct
  source 1..293: mol_type = other RNA
cgctcttccgcgtctcgtcttcatgaacgagaaggaggaccccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51869 - RNA, 293 nt, synthetic construct
  source 1..293: mol_type = other RNA
cgctcttccgcgtctcgtcttcatgaacgagaaggaggacatcccctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51870 - RNA, 293 nt, synthetic construct
  source 1..293: mol_type = other RNA
cgctcttccgcgtctcgtcttcatgaacgagaaggaggacatcctgccctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51871 - RNA, 293 nt, synthetic construct
  source 1..293: mol_type = other RNA
cgctcttccgcgtctcgtcttcatgaacgagaaggaggacatcctgtggcccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51872 - RNA, 293 nt, synthetic construct
  source 1..293: mol_type = other RNA
cgctcttccgcgtctcgtcttcatgaacgagaaggaggacatcctgtggtgccccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51873 - RNA, 293 nt, synthetic construct
  source 1..293: mol_type = other RNA
cgctcttccgcgtctcgtcttcatgaacgagaaggaggacatcctgtggtgcactcccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51874 - RNA, 293 nt, synthetic construct
  source 1..293: mol_type = other RNA
cgctcttccgcgtctcgtcttcatgaacgagaaggaggacatcctgtggtgcactgaacccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51875 - RNA, 293 nt, synthetic construct
  source 1..293: mol_type = other RNA
cgctcttccgcgtctcgtcttcatgaacgagaaggaggacatcctgtggtgcactgaaatgcccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51876 - RNA, 293 nt, synthetic construct
  source 1..293: mol_type = other RNA
cgctcttccgcgtctcgtcttcatgaacgagaaggaggacatcctgtggtgcactgaaatggaacccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51877 - RNA, 293 nt, synthetic construct
  source 1..293: mol_type = other RNA
cgctcttccgcgtctcgtcttcatgaacgagaaggaggacatcctgtggtgcactgaaatggaaaggccctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51878 - RNA, 293 nt, synthetic construct
  source 1..293: mol_type = other RNA
cgctcttccgcgtctcgtcttcatgaacgagaaggaggacatcctgtggtgcactgaaatggaaagggtgcccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51879 - RNA, 293 nt, synthetic construct
  source 1..293: mol_type = other RNA
cgctcttccgcgtctcgtcttcatgaacgagaaggaggacatcctgtggtgcactgaaatggaaagggtgtttcccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51880 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcccccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51881 - RNA, 293 nt, synthetic construct; identical to SEQ ID NO: 49292
  source 1..293: mol_type = other RNA

SEQ ID NO: 51882 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccccccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51883 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtcccctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51884 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccaccccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51885 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactaccccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51886 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacacccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51887 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacccctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51888 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgcccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51889 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtcccccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51890 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaaccccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51891 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgccccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51892 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51893 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgccccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51894 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51895 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgccccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51896 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51897 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51898 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51899 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51900 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgccccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51901 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcccctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51902 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggccctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51903 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51904 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51905 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51906 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51907 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51908 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcccccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51909 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcccccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51910 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51911 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51912 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51913 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51914 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcccctgaaggaatattttgcttgtgtgtctagcggcaatagtaacgctaacagccgcgggccgagcttcagcagcggcctggtgccgttaagcttgcgcgagacgtcggaagagc

SEQ ID NO: 51915 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcccaaggaatattttgcttgtgtgtctagcggcaatagtaacgctaacagccgcgggccgagcttcagcagcggcctggtgccgttaagcttgcgcgagacgtcggaagagc

SEQ ID NO: 51916 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcccgaatattttgcttgtgtgtctagcggcaatagtaacgctaacagccgcgggccgagcttcagcagcggcctggtgccgttaagcttgcgcgagacgtcggaagagc

SEQ ID NO: 51917 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagccctattttgcttgtgtgtctagcggcaatagtaacgctaacagccgcgggccgagcttcagcagcggcctggtgccgttaagcttgcgcgagacgtcggaagagc

SEQ ID NO: 51918 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaccctttgcttgtgtgtctagcggcaatagtaacgctaacagccgcgggccgagcttcagcagcggcctggtgccgttaagcttgcgcgagacgtcggaagagc

SEQ ID NO: 51919 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcccgcttgtgtgtctagcggcaatagtaacgctaacagccgcgggccgagcttcagcagcggcctggtgccgttaagcttgcgcgagacgtcggaagagc

SEQ ID NO: 51920 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttccctgtgtgtctagcggcaatagtaacgctaacagccgcgggccgagcttcagcagcggcctggtgccgttaagcttgcgcgagacgtcggaagagc

SEQ ID NO: 51921 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcccgtgtctagcggcaatagtaacgctaacagccgcgggccgagcttcagcagcggcctggtgccgttaagcttgcgcgagacgtcggaagagc

SEQ ID NO: 51922 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtccctctagcggcaatagtaacgctaacagccgcgggccgagcttcagcagcggcctggtgccgttaagcttgcgcgagacgtcggaagagc

SEQ ID NO: 51923 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcccagcggcaatagtaacgctaacagccgcgggccgagcttcagcagcggcctggtgccgttaagcttgcgcgagacgtcggaagagc

SEQ ID NO: 51924 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcccggcaatagtaacgctaacagccgcgggccgagcttcagcagcggcctggtgccgttaagcttgcgcgagacgtcggaagagc

SEQ ID NO: 51925 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccccaatagtaacgctaacagccgcgggccgagcttcagcagcggcctggtgccgttaagcttgcgcgagacgtcggaagagc

SEQ ID NO: 51926 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccccagtaacgctaacagccgcgggccgagcttcagcagcggcctggtgccgttaagcttgcgcgagacgtcggaagagc

SEQ ID NO: 51927 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcccaacgctaacagccgcgggccgagcttcagcagcggcctggtgccgttaagcttgcgcgagacgtcggaagagc

SEQ ID NO: 51928 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcccgctaacagccgcgggccgagcttcagcagcggcctggtgccgttaagcttgcgcgagacgtcggaagagc

SEQ ID NO: 51929 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccccaacagccgcgggccgagcttcagcagcggcctggtgccgttaagcttgcgcgagacgtcggaagagc

SEQ ID NO: 51930 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcccagccgcgggccgagcttcagcagcggcctggtgccgttaagcttgcgcgagacgtcggaagagc

SEQ ID NO: 51931 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacccccgcgggccgagcttcagcagcggcctggtgccgttaagcttgcgcgagacgtcggaagagc

SEQ ID NO: 51932 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccccgggccgagcttcagcagcggcctggtgccgttaagcttgcgcgagacgtcggaagagc

SEQ ID NO: 51933 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccccccgagcttcagcagcggcctggtgccgttaagcttgcgcgagacgtcggaagagc

SEQ ID NO: 51934 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcccagcttcagcagcggcctggtgccgttaagcttgcgcgagacgtcggaagagc

SEQ ID NO: 51935 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcccttcagcagcggcctggtgccgttaagcttgcgcgagacgtcggaagagc

SEQ ID NO: 51936 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccccagcagcggcctggtgccgttaagcttgcgcgagacgtcggaagagc

SEQ ID NO: 51937 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccccagcggcctggtgccgttaagcttgcgcgagacgtcggaagagc

SEQ ID NO: 51938 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccccggcctggtgccgttaagcttgcgcgagacgtcggaagagc

SEQ ID NO: 51939 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccccctggtgccgttaagcttgcgcgagacgtcggaagagc

SEQ ID NO: 51940 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccccgtgccgttaagcttgcgcgagacgtcggaagagc

SEQ ID NO: 51941 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcccccgttaagcttgcgcgagacgtcggaagagc

SEQ ID NO: 51942 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcccttaagcttgcgcgagacgtcggaagagc

SEQ ID NO: 51943 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcccagcttgcgcgagacgtcggaagagc

SEQ ID NO: 51944 - RNA, 293 nt, synthetic construct
  source 1..293: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacccttgcgcgagacgtcggaagagc

SEQ ID NO: 51945 - RNA, 296 nt, synthetic construct
  source 1..296: mol_type = other RNA
cgctcttccgcgtctcgtcttcatgaagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51946 - RNA, 296 nt, synthetic construct
  source 1..296: mol_type = other RNA
cgctcttccgcgtctcgtcttcatgaacaaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51947 - RNA, 296 nt, synthetic construct
  source 1..296: mol_type = other RNA
cgctcttccgcgtctcgtcttcatgaacgagaagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51948 - RNA, 296 nt, synthetic construct; identical to SEQ ID NO: 51947
  source 1..296: mol_type = other RNA

SEQ ID NO: 51949 - RNA, 296 nt, synthetic construct
  source 1..296: mol_type = other RNA
cgctcttccgcgtctcgtcttcatgaacgagaaggagaaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51950 - RNA, 296 nt, synthetic construct
  source 1..296: mol_type = other RNA
cgctcttccgcgtctcgtcttcatgaacgagaaggaggacaagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51951 - RNA, 296 nt, synthetic construct
  source 1..296: mol_type = other RNA
cgctcttccgcgtctcgtcttcatgaacgagaaggaggacatcaagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51952 - RNA, 296 nt, synthetic construct
  source 1..296: mol_type = other RNA
cgctcttccgcgtctcgtcttcatgaacgagaaggaggacatcctgaagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51953 - RNA, 296 nt, synthetic construct
  source 1..296: mol_type = other RNA
cgctcttccgcgtctcgtcttcatgaacgagaaggaggacatcctgtggaagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51954 - RNA, 296 nt, synthetic construct
  source 1..296: mol_type = other RNA
cgctcttccgcgtctcgtcttcatgaacgagaaggaggacatcctgtggtgcaagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51955 - RNA, 296 nt, synthetic construct
  source 1..296: mol_type = other RNA
cgctcttccgcgtctcgtcttcatgaacgagaaggaggacatcctgtggtgcactaaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51956 - RNA, 296 nt, synthetic construct
  source 1..296: mol_type = other RNA
cgctcttccgcgtctcgtcttcatgaacgagaaggaggacatcctgtggtgcactgaaaagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51957 - RNA, 296 nt, synthetic construct
  source 1..296: mol_type = other RNA
cgctcttccgcgtctcgtcttcatgaacgagaaggaggacatcctgtggtgcactgaaatgaaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51958 - RNA, 296 nt, synthetic construct
  source 1..296: mol_type = other RNA
cgctcttccgcgtctcgtcttcatgaacgagaaggaggacatcctgtggtgcactgaaatggaaaagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51959 - RNA, 296 nt, synthetic construct
  source 1..296: mol_type = other RNA
cgctcttccgcgtctcgtcttcatgaacgagaaggaggacatcctgtggtgcactgaaatggaaaggaaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51960 - RNA, 296 nt, synthetic construct
  source 1..296: mol_type = other RNA
cgctcttccgcgtctcgtcttcatgaacgagaaggaggacatcctgtggtgcactgaaatggaaagggtgaagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51961 - RNA, 296 nt, synthetic construct
  source 1..296: mol_type = other RNA
cgctcttccgcgtctcgtcttcatgaacgagaaggaggacatcctgtggtgcactgaaatggaaagggtgtttaagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51962 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcaagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51963 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcaagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51964 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccaaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51965 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcaagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51966 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacaagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51967 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacaagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51968 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaaaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51969 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacaaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51970 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgaagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51971 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51972 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacaagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51973 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgaagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51974 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcaagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51975 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51976 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51977 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51978 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51979 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51980 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51981 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51982 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51983 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcaagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51984 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggaagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51985 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51986 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51987 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51988 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51989 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51990 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51991 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcaagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51992 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51993 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51994 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51995 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51996 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 51997 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaagctgaaggaatattttgcttgtgtgtctagcggcaatagtaacgctaacagccgcgggccgagcttcagcagcggcctggtgccgttaagcttgcgcgagacgtcggaagagc

SEQ ID NO: 51998 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagaaggaatattttgcttgtgtgtctagcggcaatagtaacgctaacagccgcgggccgagcttcagcagcggcctggtgccgttaagcttgcgcgagacgtcggaagagc

SEQ ID NO: 51999 - RNA, 296 nt, synthetic construct; identical to SEQ ID NO: 51998
  source 1..296: mol_type = other RNA

SEQ ID NO: 52000 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaaagtattttgcttgtgtgtctagcggcaatagtaacgctaacagccgcgggccgagcttcagcagcggcctggtgccgttaagcttgcgcgagacgtcggaagagc

SEQ ID NO: 52001 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatataagtttgcttgtgtgtctagcggcaatagtaacgctaacagccgcgggccgagcttcagcagcggcctggtgccgttaagcttgcgcgagacgtcggaagagc

SEQ ID NO: 52002 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttaaggcttgtgtgtctagcggcaatagtaacgctaacagccgcgggccgagcttcagcagcggcctggtgccgttaagcttgcgcgagacgtcggaagagc

SEQ ID NO: 52003 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctaagtgtgtgtctagcggcaatagtaacgctaacagccgcgggccgagcttcagcagcggcctggtgccgttaagcttgcgcgagacgtcggaagagc

SEQ ID NO: 52004 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtaaggtgtctagcggcaatagtaacgctaacagccgcgggccgagcttcagcagcggcctggtgccgttaagcttgcgcgagacgtcggaagagc

SEQ ID NO: 52005 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaagtctagcggcaatagtaacgctaacagccgcgggccgagcttcagcagcggcctggtgccgttaagcttgcgcgagacgtcggaagagc

SEQ ID NO: 52006 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaagagcggcaatagtaacgctaacagccgcgggccgagcttcagcagcggcctggtgccgttaagcttgcgcgagacgtcggaagagc

SEQ ID NO: 52007 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaagggcaatagtaacgctaacagccgcgggccgagcttcagcagcggcctggtgccgttaagcttgcgcgagacgtcggaagagc

SEQ ID NO: 52008 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaagaatagtaacgctaacagccgcgggccgagcttcagcagcggcctggtgccgttaagcttgcgcgagacgtcggaagagc

SEQ ID NO: 52009 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataagagtaacgctaacagccgcgggccgagcttcagcagcggcctggtgccgttaagcttgcgcgagacgtcggaagagc

SEQ ID NO: 52010 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaagaacgctaacagccgcgggccgagcttcagcagcggcctggtgccgttaagcttgcgcgagacgtcggaagagc

SEQ ID NO: 52011 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaaggctaacagccgcgggccgagcttcagcagcggcctggtgccgttaagcttgcgcgagacgtcggaagagc

SEQ ID NO: 52012 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaagaacagccgcgggccgagcttcagcagcggcctggtgccgttaagcttgcgcgagacgtcggaagagc

SEQ ID NO: 52013 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaagagccgcgggccgagcttcagcagcggcctggtgccgttaagcttgcgcgagacgtcggaagagc

SEQ ID NO: 52014 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcaagcgcgggccgagcttcagcagcggcctggtgccgttaagcttgcgcgagacgtcggaagagc

SEQ ID NO: 52015 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaaggggccgagcttcagcagcggcctggtgccgttaagcttgcgcgagacgtcggaagagc

SEQ ID NO: 52016 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaagccgagcttcagcagcggcctggtgccgttaagcttgcgcgagacgtcggaagagc

SEQ ID NO: 52017 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaagagcttcagcagcggcctggtgccgttaagcttgcgcgagacgtcggaagagc

SEQ ID NO: 52018 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaagttcagcagcggcctggtgccgttaagcttgcgcgagacgtcggaagagc

SEQ ID NO: 52019 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaagagcagcggcctggtgccgttaagcttgcgcgagacgtcggaagagc

SEQ ID NO: 52020 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaagagcggcctggtgccgttaagcttgcgcgagacgtcggaagagc

SEQ ID NO: 52021 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaagggcctggtgccgttaagcttgcgcgagacgtcggaagagc

SEQ ID NO: 52022 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaagctggtgccgttaagcttgcgcgagacgtcggaagagc

SEQ ID NO: 52023 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaaggtgccgttaagcttgcgcgagacgtcggaagagc

SEQ ID NO: 52024 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaagccgttaagcttgcgcgagacgtcggaagagc

SEQ ID NO: 52025 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaagttaagcttgcgcgagacgtcggaagagc

SEQ ID NO: 52026 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaagagcttgcgcgagacgtcggaagagc

SEQ ID NO: 52027 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcaagttgcgcgagacgtcggaagagc

SEQ ID NO: 52028 - RNA, 296 nt, synthetic construct
  source 1..296: mol_type = other RNA
cgctcttccgcgtctcgtcttcatgaacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52029 - RNA, 296 nt, synthetic construct; identical to SEQ ID NO: 52028
  source 1..296: mol_type = other RNA

SEQ ID NO: 52030 - RNA, 296 nt, synthetic construct
  source 1..296: mol_type = other RNA
cgctcttccgcgtctcgtcttcatgaacgagaacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52031 - RNA, 296 nt, synthetic construct
  source 1..296: mol_type = other RNA
cgctcttccgcgtctcgtcttcatgaacgagaagaacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52032 - RNA, 296 nt, synthetic construct
  source 1..296: mol_type = other RNA
cgctcttccgcgtctcgtcttcatgaacgagaaggagaacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52033 - RNA, 296 nt, synthetic construct
  source 1..296: mol_type = other RNA
cgctcttccgcgtctcgtcttcatgaacgagaaggaggacaacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52034 - RNA, 296 nt, synthetic construct
  source 1..296: mol_type = other RNA
cgctcttccgcgtctcgtcttcatgaacgagaaggaggacatcaacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52035 - RNA, 296 nt, synthetic construct
  source 1..296: mol_type = other RNA
cgctcttccgcgtctcgtcttcatgaacgagaaggaggacatcctgaactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52036 - RNA, 296 nt, synthetic construct
  source 1..296: mol_type = other RNA
cgctcttccgcgtctcgtcttcatgaacgagaaggaggacatcctgtggaactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52037 - RNA, 296 nt, synthetic construct
  source 1..296: mol_type = other RNA
cgctcttccgcgtctcgtcttcatgaacgagaaggaggacatcctgtggtgcaacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52038 - RNA, 296 nt, synthetic construct
  source 1..296: mol_type = other RNA
cgctcttccgcgtctcgtcttcatgaacgagaaggaggacatcctgtggtgcactaacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52039 - RNA, 296 nt, synthetic construct
  source 1..296: mol_type = other RNA
cgctcttccgcgtctcgtcttcatgaacgagaaggaggacatcctgtggtgcactgaaaacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52040 - RNA, 296 nt, synthetic construct
  source 1..296: mol_type = other RNA
cgctcttccgcgtctcgtcttcatgaacgagaaggaggacatcctgtggtgcactgaaatgaacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52041 - RNA, 296 nt, synthetic construct
  source 1..296: mol_type = other RNA
cgctcttccgcgtctcgtcttcatgaacgagaaggaggacatcctgtggtgcactgaaatggaaaacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52042 - RNA, 296 nt, synthetic construct
  source 1..296: mol_type = other RNA
cgctcttccgcgtctcgtcttcatgaacgagaaggaggacatcctgtggtgcactgaaatggaaaggaacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52043 - RNA, 296 nt, synthetic construct
  source 1..296: mol_type = other RNA
cgctcttccgcgtctcgtcttcatgaacgagaaggaggacatcctgtggtgcactgaaatggaaagggtgaactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52044 - RNA, 296 nt, synthetic construct
  source 1..296: mol_type = other RNA
cgctcttccgcgtctcgtcttcatgaacgagaaggaggacatcctgtggtgcactgaaatggaaagggtgtttaacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52045 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcaacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52046 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcaaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52047 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccaacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52048 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcaaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52049 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacaactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52050 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacaacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52051 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaaacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52052 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacaacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52053 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgaactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52054 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52055 - RNA, 296 nt, synthetic construct; identical to SEQ ID NO: 52054
  source 1..296: mol_type = other RNA

SEQ ID NO: 52056 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgaacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52057 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcaaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52058 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52059 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52060 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52061 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52062 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52063 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52064 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52065 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52066 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcaaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52067 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggaactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52068 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52069 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52070 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52071 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52072 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52073 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52074 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcaaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52075 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52076 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52077 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52078 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52079 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52080 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaacctgaaggaatattttgcttgtgtgtctagcggcaatagtaacgctaacagccgcgggccgagcttcagcagcggcctggtgccgttaagcttgcgcgagacgtcggaagagc

SEQ ID NO: 52081 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaacaaggaatattttgcttgtgtgtctagcggcaatagtaacgctaacagccgcgggccgagcttcagcagcggcctggtgccgttaagcttgcgcgagacgtcggaagagc

SEQ ID NO: 52082 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagaacgaatattttgcttgtgtgtctagcggcaatagtaacgctaacagccgcgggccgagcttcagcagcggcctggtgccgttaagcttgcgcgagacgtcggaagagc

SEQ ID NO: 52083 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaaactattttgcttgtgtgtctagcggcaatagtaacgctaacagccgcgggccgagcttcagcagcggcctggtgccgttaagcttgcgcgagacgtcggaagagc

SEQ ID NO: 52084 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatataactttgcttgtgtgtctagcggcaatagtaacgctaacagccgcgggccgagcttcagcagcggcctggtgccgttaagcttgcgcgagacgtcggaagagc

SEQ ID NO: 52085 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttaacgcttgtgtgtctagcggcaatagtaacgctaacagccgcgggccgagcttcagcagcggcctggtgccgttaagcttgcgcgagacgtcggaagagc

SEQ ID NO: 52086 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctaactgtgtgtctagcggcaatagtaacgctaacagccgcgggccgagcttcagcagcggcctggtgccgttaagcttgcgcgagacgtcggaagagc

SEQ ID NO: 52087 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtaacgtgtctagcggcaatagtaacgctaacagccgcgggccgagcttcagcagcggcctggtgccgttaagcttgcgcgagacgtcggaagagc

SEQ ID NO: 52088 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaactctagcggcaatagtaacgctaacagccgcgggccgagcttcagcagcggcctggtgccgttaagcttgcgcgagacgtcggaagagc

SEQ ID NO: 52089 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaacagcggcaatagtaacgctaacagccgcgggccgagcttcagcagcggcctggtgccgttaagcttgcgcgagacgtcggaagagc

SEQ ID NO: 52090 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaacggcaatagtaacgctaacagccgcgggccgagcttcagcagcggcctggtgccgttaagcttgcgcgagacgtcggaagagc

SEQ ID NO: 52091 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaacaatagtaacgctaacagccgcgggccgagcttcagcagcggcctggtgccgttaagcttgcgcgagacgtcggaagagc

SEQ ID NO: 52092 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataacagtaacgctaacagccgcgggccgagcttcagcagcggcctggtgccgttaagcttgcgcgagacgtcggaagagc

SEQ ID NO: 52093 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaacgctaacagccgcgggccgagcttcagcagcggcctggtgccgttaagcttgcgcgagacgtcggaagagc

SEQ ID NO: 52094 - RNA, 296 nt, synthetic construct; identical to SEQ ID NO: 52093
  source 1..296: mol_type = other RNA

SEQ ID NO: 52095 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaacagccgcgggccgagcttcagcagcggcctggtgccgttaagcttgcgcgagacgtcggaagagc

SEQ ID NO: 52096 - RNA, 296 nt, synthetic construct; identical to SEQ ID NO: 52095
  source 1..296: mol_type = other RNA

SEQ ID NO: 52097 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcaaccgcgggccgagcttcagcagcggcctggtgccgttaagcttgcgcgagacgtcggaagagc

SEQ ID NO: 52098 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaacgggccgagcttcagcagcggcctggtgccgttaagcttgcgcgagacgtcggaagagc

SEQ ID NO: 52099 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaacccgagcttcagcagcggcctggtgccgttaagcttgcgcgagacgtcggaagagc

SEQ ID NO: 52100 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaacagcttcagcagcggcctggtgccgttaagcttgcgcgagacgtcggaagagc

SEQ ID NO: 52101 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaacttcagcagcggcctggtgccgttaagcttgcgcgagacgtcggaagagc

SEQ ID NO: 52102 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaacagcagcggcctggtgccgttaagcttgcgcgagacgtcggaagagc

SEQ ID NO: 52103 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaacagcggcctggtgccgttaagcttgcgcgagacgtcggaagagc

SEQ ID NO: 52104 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaacggcctggtgccgttaagcttgcgcgagacgtcggaagagc

SEQ ID NO: 52105 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaacctggtgccgttaagcttgcgcgagacgtcggaagagc

SEQ ID NO: 52106 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaacgtgccgttaagcttgcgcgagacgtcggaagagc

SEQ ID NO: 52107 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaacccgttaagcttgcgcgagacgtcggaagagc

SEQ ID NO: 52108 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaacttaagcttgcgcgagacgtcggaagagc

SEQ ID NO: 52109 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaacagcttgcgcgagacgtcggaagagc

SEQ ID NO: 52110 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcaacttgcgcgagacgtcggaagagc

SEQ ID NO: 52111 - RNA, 296 nt, synthetic construct
  source 1..296: mol_type = other RNA
cgctcttccgcgtctcgtcttcatgatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52112 - RNA, 296 nt, synthetic construct
  source 1..296: mol_type = other RNA
cgctcttccgcgtctcgtcttcatgaacatggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52113 - RNA, 296 nt, synthetic construct
  source 1..296: mol_type = other RNA
cgctcttccgcgtctcgtcttcatgaacgagatgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52114 - RNA, 296 nt, synthetic construct
  source 1..296: mol_type = other RNA
cgctcttccgcgtctcgtcttcatgaacgagaagatggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52115 - RNA, 296 nt, synthetic construct
  source 1..296: mol_type = other RNA
cgctcttccgcgtctcgtcttcatgaacgagaaggagatggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52116 - RNA, 296 nt, synthetic construct
  source 1..296: mol_type = other RNA
cgctcttccgcgtctcgtcttcatgaacgagaaggaggacatgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52117 - RNA, 296 nt, synthetic construct
  source 1..296: mol_type = other RNA
cgctcttccgcgtctcgtcttcatgaacgagaaggaggacatcatgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52118 - RNA, 296 nt, synthetic construct
  source 1..296: mol_type = other RNA
cgctcttccgcgtctcgtcttcatgaacgagaaggaggacatcctgatgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52119 - RNA, 296 nt, synthetic construct
  source 1..296: mol_type = other RNA
cgctcttccgcgtctcgtcttcatgaacgagaaggaggacatcctgtggatgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52120 - RNA, 296 nt, synthetic construct
  source 1..296: mol_type = other RNA
cgctcttccgcgtctcgtcttcatgaacgagaaggaggacatcctgtggtgcatgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52121 - RNA, 296 nt, synthetic construct
  source 1..296: mol_type = other RNA
cgctcttccgcgtctcgtcttcatgaacgagaaggaggacatcctgtggtgcactatggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52122 - RNA, 296 nt, synthetic construct
  source 1..296: mol_type = other RNA
cgctcttccgcgtctcgtcttcatgaacgagaaggaggacatcctgtggtgcactgaaatgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52123 - RNA, 296 nt, synthetic construct; identical to SEQ ID NO: 52122
  source 1..296: mol_type = other RNA

SEQ ID NO: 52124 - RNA, 296 nt, synthetic construct
  source 1..296: mol_type = other RNA
cgctcttccgcgtctcgtcttcatgaacgagaaggaggacatcctgtggtgcactgaaatggaaatgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52125 - RNA, 296 nt, synthetic construct
  source 1..296: mol_type = other RNA
cgctcttccgcgtctcgtcttcatgaacgagaaggaggacatcctgtggtgcactgaaatggaaaggatggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52126 - RNA, 296 nt, synthetic construct
  source 1..296: mol_type = other RNA
cgctcttccgcgtctcgtcttcatgaacgagaaggaggacatcctgtggtgcactgaaatggaaagggtgatgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52127 - RNA, 296 nt, synthetic construct
  source 1..296: mol_type = other RNA
cgctcttccgcgtctcgtcttcatgaacgagaaggaggacatcctgtggtgcactgaaatggaaagggtgtttatgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52128 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcatgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52129 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcatgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52130 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccatggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52131 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcatgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52132 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacatgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52133 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacatgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52134 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaatggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52135 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacatggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52136 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgatgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52137 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccatgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52138 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52139 - RNA, 296 nt, synthetic construct; identical to SEQ ID NO: 52138
  source 1..296: mol_type = other RNA

SEQ ID NO: 52140 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcatgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52141 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcatgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52142 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgatggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52143 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgatgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52144 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggatgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52145 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagatgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52146 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaatgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52147 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgatgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52148 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgatgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52149 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcatgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52150 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggatgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52151 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgatgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52152 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggatgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52153 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcatggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52154 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgatgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52155 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgatggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52156 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52157 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcatgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52158 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcatgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52159 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacatgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52160 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcatgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52161 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcatggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52162 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctatgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52163 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgatgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52164 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgatgaaggaatattttgcttgtgtgtctagcggcaatagtaacgctaacagccgcgggccgagcttcagcagcggcctggtgccgttaagcttgcgcgagacgtcggaagagc

SEQ ID NO: 52165 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagatggaatattttgcttgtgtgtctagcggcaatagtaacgctaacagccgcgggccgagcttcagcagcggcctggtgccgttaagcttgcgcgagacgtcggaagagc

SEQ ID NO: 52166 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaatgtattttgcttgtgtgtctagcggcaatagtaacgctaacagccgcgggccgagcttcagcagcggcctggtgccgttaagcttgcgcgagacgtcggaagagc

SEQ ID NO: 52167 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatatgtttgcttgtgtgtctagcggcaatagtaacgctaacagccgcgggccgagcttcagcagcggcctggtgccgttaagcttgcgcgagacgtcggaagagc

SEQ ID NO: 52168 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttatggcttgtgtgtctagcggcaatagtaacgctaacagccgcgggccgagcttcagcagcggcctggtgccgttaagcttgcgcgagacgtcggaagagc

SEQ ID NO: 52169 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctatgtgtgtgtctagcggcaatagtaacgctaacagccgcgggccgagcttcagcagcggcctggtgccgttaagcttgcgcgagacgtcggaagagc

SEQ ID NO: 52170 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtatggtgtctagcggcaatagtaacgctaacagccgcgggccgagcttcagcagcggcctggtgccgttaagcttgcgcgagacgtcggaagagc

SEQ ID NO: 52171 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgatgtctagcggcaatagtaacgctaacagccgcgggccgagcttcagcagcggcctggtgccgttaagcttgcgcgagacgtcggaagagc

SEQ ID NO: 52172 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctatgagcggcaatagtaacgctaacagccgcgggccgagcttcagcagcggcctggtgccgttaagcttgcgcgagacgtcggaagagc

SEQ ID NO: 52173 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcatgggcaatagtaacgctaacagccgcgggccgagcttcagcagcggcctggtgccgttaagcttgcgcgagacgtcggaagagc

SEQ ID NO: 52174 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcatgaatagtaacgctaacagccgcgggccgagcttcagcagcggcctggtgccgttaagcttgcgcgagacgtcggaagagc

SEQ ID NO: 52175 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatatgagtaacgctaacagccgcgggccgagcttcagcagcggcctggtgccgttaagcttgcgcgagacgtcggaagagc

SEQ ID NO: 52176 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtatgaacgctaacagccgcgggccgagcttcagcagcggcctggtgccgttaagcttgcgcgagacgtcggaagagc

SEQ ID NO: 52177 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacatggctaacagccgcgggccgagcttcagcagcggcctggtgccgttaagcttgcgcgagacgtcggaagagc

SEQ ID NO: 52178 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctatgaacagccgcgggccgagcttcagcagcggcctggtgccgttaagcttgcgcgagacgtcggaagagc

SEQ ID NO: 52179 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacatgagccgcgggccgagcttcagcagcggcctggtgccgttaagcttgcgcgagacgtcggaagagc

SEQ ID NO: 52180 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcatgcgcgggccgagcttcagcagcggcctggtgccgttaagcttgcgcgagacgtcggaagagc

SEQ ID NO: 52181 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcatggggccgagcttcagcagcggcctggtgccgttaagcttgcgcgagacgtcggaagagc

SEQ ID NO: 52182 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggatgccgagcttcagcagcggcctggtgccgttaagcttgcgcgagacgtcggaagagc

SEQ ID NO: 52183 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgatgagcttcagcagcggcctggtgccgttaagcttgcgcgagacgtcggaagagc

SEQ ID NO: 52184 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcatgttcagcagcggcctggtgccgttaagcttgcgcgagacgtcggaagagc

SEQ ID NO: 52185 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcatgagcagcggcctggtgccgttaagcttgcgcgagacgtcggaagagc

SEQ ID NO: 52186 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcatgagcggcctggtgccgttaagcttgcgcgagacgtcggaagagc

SEQ ID NO: 52187 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcatgggcctggtgccgttaagcttgcgcgagacgtcggaagagc

SEQ ID NO: 52188 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcatgctggtgccgttaagcttgcgcgagacgtcggaagagc

SEQ ID NO: 52189 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgatggtgccgttaagcttgcgcgagacgtcggaagagc

SEQ ID NO: 52190 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgatgccgttaagcttgcgcgagacgtcggaagagc

SEQ ID NO: 52191 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgatgttaagcttgcgcgagacgtcggaagagc

SEQ ID NO: 52192 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaatgagcttgcgcgagacgtcggaagagc

SEQ ID NO: 52193 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcatgttgcgcgagacgtcggaagagc

SEQ ID NO: 52194 - RNA, 296 nt, synthetic construct
  source 1..296: mol_type = other RNA
cgctcttccgcgtctcgtcttcatgatcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52195 - RNA, 296 nt, synthetic construct
  source 1..296: mol_type = other RNA
cgctcttccgcgtctcgtcttcatgaacatcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52196 - RNA, 296 nt, synthetic construct
  source 1..296: mol_type = other RNA
cgctcttccgcgtctcgtcttcatgaacgagatcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52197 - RNA, 296 nt, synthetic construct
  source 1..296: mol_type = other RNA
cgctcttccgcgtctcgtcttcatgaacgagaagatcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52198 - RNA, 296 nt, synthetic construct
  source 1..296: mol_type = other RNA
cgctcttccgcgtctcgtcttcatgaacgagaaggagatcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52199 - RNA, 296 nt, synthetic construct
  source 1..296: mol_type = other RNA
cgctcttccgcgtctcgtcttcatgaacgagaaggaggacatcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52200 - RNA, 296 nt, synthetic construct; identical to SEQ ID NO: 52199
  source 1..296: mol_type = other RNA

SEQ ID NO: 52201 - RNA, 296 nt, synthetic construct
  source 1..296: mol_type = other RNA
cgctcttccgcgtctcgtcttcatgaacgagaaggaggacatcctgatctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52202 - RNA, 296 nt, synthetic construct
  source 1..296: mol_type = other RNA
cgctcttccgcgtctcgtcttcatgaacgagaaggaggacatcctgtggatctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52203 - RNA, 296 nt, synthetic construct
  source 1..296: mol_type = other RNA
cgctcttccgcgtctcgtcttcatgaacgagaaggaggacatcctgtggtgcatcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52204 - RNA, 296 nt, synthetic construct
  source 1..296: mol_type = other RNA
cgctcttccgcgtctcgtcttcatgaacgagaaggaggacatcctgtggtgcactatcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52205 - RNA, 296 nt, synthetic construct
  source 1..296: mol_type = other RNA
cgctcttccgcgtctcgtcttcatgaacgagaaggaggacatcctgtggtgcactgaaatcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52206 - RNA, 296 nt, synthetic construct
  source 1..296: mol_type = other RNA
cgctcttccgcgtctcgtcttcatgaacgagaaggaggacatcctgtggtgcactgaaatgatcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52207 - RNA, 296 nt, synthetic construct
  source 1..296: mol_type = other RNA
cgctcttccgcgtctcgtcttcatgaacgagaaggaggacatcctgtggtgcactgaaatggaaatcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52208 - RNA, 296 nt, synthetic construct
  source 1..296: mol_type = other RNA
cgctcttccgcgtctcgtcttcatgaacgagaaggaggacatcctgtggtgcactgaaatggaaaggatcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52209 - RNA, 296 nt, synthetic construct
  source 1..296: mol_type = other RNA
cgctcttccgcgtctcgtcttcatgaacgagaaggaggacatcctgtggtgcactgaaatggaaagggtgatctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52210 - RNA, 296 nt, synthetic construct
  source 1..296: mol_type = other RNA
cgctcttccgcgtctcgtcttcatgaacgagaaggaggacatcctgtggtgcactgaaatggaaagggtgtttatcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52211 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcatcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52212 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcatccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52213 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccatcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52214 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcatccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52215 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacatctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52216 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacatcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52217 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaatcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52218 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacatcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52219 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgatctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52220 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccatcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52221 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52222 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgatcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52223 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcatccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52224 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcatcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52225 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgatcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52226 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgatcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52227 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggatccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52228 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagatcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52229 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaatcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52230 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgatcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52231 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgatcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52232 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcatccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52233 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggatctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52234 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgatctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52235 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggatcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52236 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcatcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52237 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgatcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52238 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgatcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52239 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52240 - RNA, 296 nt, synthetic construct; identical to SEQ ID NO: 52239
  source 1..296: mol_type = other RNA

SEQ ID NO: 52241 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcatccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52242 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacatcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52243 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcatcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52244 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcatcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52245 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctatcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52246 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgatcctgaaggaatattttgcttgtgtgtctagcggcaatagtaacgctaacagccgcgggccgagcttcagcagcggcctggtgccgttaagcttgcgcgagacgtcggaagagc

SEQ ID NO: 52247 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgatcaaggaatattttgcttgtgtgtctagcggcaatagtaacgctaacagccgcgggccgagcttcagcagcggcctggtgccgttaagcttgcgcgagacgtcggaagagc

SEQ ID NO: 52248 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagatcgaatattttgcttgtgtgtctagcggcaatagtaacgctaacagccgcgggccgagcttcagcagcggcctggtgccgttaagcttgcgcgagacgtcggaagagc

SEQ ID NO: 52249 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaatctattttgcttgtgtgtctagcggcaatagtaacgctaacagccgcgggccgagcttcagcagcggcctggtgccgttaagcttgcgcgagacgtcggaagagc

SEQ ID NO: 52250 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatatctttgcttgtgtgtctagcggcaatagtaacgctaacagccgcgggccgagcttcagcagcggcctggtgccgttaagcttgcgcgagacgtcggaagagc

SEQ ID NO: 52251 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttatcgcttgtgtgtctagcggcaatagtaacgctaacagccgcgggccgagcttcagcagcggcctggtgccgttaagcttgcgcgagacgtcggaagagc

SEQ ID NO: 52252 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctatctgtgtgtctagcggcaatagtaacgctaacagccgcgggccgagcttcagcagcggcctggtgccgttaagcttgcgcgagacgtcggaagagc

SEQ ID NO: 52253 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtatcgtgtctagcggcaatagtaacgctaacagccgcgggccgagcttcagcagcggcctggtgccgttaagcttgcgcgagacgtcggaagagc

SEQ ID NO: 52254 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgatctctagcggcaatagtaacgctaacagccgcgggccgagcttcagcagcggcctggtgccgttaagcttgcgcgagacgtcggaagagc

SEQ ID NO: 52255 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctatcagcggcaatagtaacgctaacagccgcgggccgagcttcagcagcggcctggtgccgttaagcttgcgcgagacgtcggaagagc

SEQ ID NO: 52256 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcatcggcaatagtaacgctaacagccgcgggccgagcttcagcagcggcctggtgccgttaagcttgcgcgagacgtcggaagagc

SEQ ID NO: 52257 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcatcaatagtaacgctaacagccgcgggccgagcttcagcagcggcctggtgccgttaagcttgcgcgagacgtcggaagagc

SEQ ID NO: 52258 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatatcagtaacgctaacagccgcgggccgagcttcagcagcggcctggtgccgttaagcttgcgcgagacgtcggaagagc

SEQ ID NO: 52259 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtatcaacgctaacagccgcgggccgagcttcagcagcggcctggtgccgttaagcttgcgcgagacgtcggaagagc

SEQ ID NO: 52260 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacatcgctaacagccgcgggccgagcttcagcagcggcctggtgccgttaagcttgcgcgagacgtcggaagagc

SEQ ID NO: 52261 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctatcaacagccgcgggccgagcttcagcagcggcctggtgccgttaagcttgcgcgagacgtcggaagagc

SEQ ID NO: 52262 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacatcagccgcgggccgagcttcagcagcggcctggtgccgttaagcttgcgcgagacgtcggaagagc

SEQ ID NO: 52263 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcatccgcgggccgagcttcagcagcggcctggtgccgttaagcttgcgcgagacgtcggaagagc

SEQ ID NO: 52264 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcatcgggccgagcttcagcagcggcctggtgccgttaagcttgcgcgagacgtcggaagagc

SEQ ID NO: 52265 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggatcccgagcttcagcagcggcctggtgccgttaagcttgcgcgagacgtcggaagagc

SEQ ID NO: 52266 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgatcagcttcagcagcggcctggtgccgttaagcttgcgcgagacgtcggaagagc

SEQ ID NO: 52267 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcatcttcagcagcggcctggtgccgttaagcttgcgcgagacgtcggaagagc

SEQ ID NO: 52268 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcatcagcagcggcctggtgccgttaagcttgcgcgagacgtcggaagagc

SEQ ID NO: 52269 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcatcagcggcctggtgccgttaagcttgcgcgagacgtcggaagagc

SEQ ID NO: 52270 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcatcggcctggtgccgttaagcttgcgcgagacgtcggaagagc

SEQ ID NO: 52271 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcatcctggtgccgttaagcttgcgcgagacgtcggaagagc

SEQ ID NO: 52272 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgatcgtgccgttaagcttgcgcgagacgtcggaagagc

SEQ ID NO: 52273 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgatcccgttaagcttgcgcgagacgtcggaagagc

SEQ ID NO: 52274 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgatcttaagcttgcgcgagacgtcggaagagc

SEQ ID NO: 52275 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaatcagcttgcgcgagacgtcggaagagc

SEQ ID NO: 52276 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcatcttgcgcgagacgtcggaagagc

SEQ ID NO: 52277 - RNA, 296 nt, synthetic construct
  source 1..296: mol_type = other RNA
cgctcttccgcgtctcgtcttcatgaggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52278 - RNA, 296 nt, synthetic construct
  source 1..296: mol_type = other RNA
cgctcttccgcgtctcgtcttcatgaacagggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52279 - RNA, 296 nt, synthetic construct
  source 1..296: mol_type = other RNA
cgctcttccgcgtctcgtcttcatgaacgagaggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52280 - RNA, 296 nt, synthetic construct
  source 1..296: mol_type = other RNA
cgctcttccgcgtctcgtcttcatgaacgagaagagggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52281 - RNA, 296 nt, synthetic construct
  source 1..296: mol_type = other RNA
cgctcttccgcgtctcgtcttcatgaacgagaaggagagggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52282 - RNA, 296 nt, synthetic construct
  source 1..296: mol_type = other RNA
cgctcttccgcgtctcgtcttcatgaacgagaaggaggacaggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52283 - RNA, 296 nt, synthetic construct
  source 1..296: mol_type = other RNA
cgctcttccgcgtctcgtcttcatgaacgagaaggaggacatcaggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52284 - RNA, 296 nt, synthetic construct
  source 1..296: mol_type = other RNA
cgctcttccgcgtctcgtcttcatgaacgagaaggaggacatcctgaggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52285 - RNA, 296 nt, synthetic construct
  source 1..296: mol_type = other RNA
cgctcttccgcgtctcgtcttcatgaacgagaaggaggacatcctgtggaggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52286 - RNA, 296 nt, synthetic construct
  source 1..296: mol_type = other RNA
cgctcttccgcgtctcgtcttcatgaacgagaaggaggacatcctgtggtgcaggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52287 - RNA, 296 nt, synthetic construct
  source 1..296: mol_type = other RNA
cgctcttccgcgtctcgtcttcatgaacgagaaggaggacatcctgtggtgcactagggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52288 - RNA, 296 nt, synthetic construct
  source 1..296: mol_type = other RNA
cgctcttccgcgtctcgtcttcatgaacgagaaggaggacatcctgtggtgcactgaaaggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52289 - RNA, 296 nt, synthetic construct
  source 1..296: mol_type = other RNA
cgctcttccgcgtctcgtcttcatgaacgagaaggaggacatcctgtggtgcactgaaatgagggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52290 - RNA, 296 nt, synthetic construct
  source 1..296: mol_type = other RNA
cgctcttccgcgtctcgtcttcatgaacgagaaggaggacatcctgtggtgcactgaaatggaaaggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52291 - RNA, 296 nt, synthetic construct; identical to SEQ ID NO: 52290
  source 1..296: mol_type = other RNA

SEQ ID NO: 52292 - RNA, 296 nt, synthetic construct
  source 1..296: mol_type = other RNA
cgctcttccgcgtctcgtcttcatgaacgagaaggaggacatcctgtggtgcactgaaatggaaagggtgaggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52293 - RNA, 296 nt, synthetic construct
  source 1..296: mol_type = other RNA
cgctcttccgcgtctcgtcttcatgaacgagaaggaggacatcctgtggtgcactgaaatggaaagggtgtttaggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52294 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcaggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52295 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcaggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52296 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccagggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52297 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcaggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52298 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacaggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52299 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacaggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52300 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaagggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52301 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacagggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52302 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgaggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52303 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52304 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacaggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52305 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgaggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52306 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcaggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52307 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52308 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgagggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52309 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52310 - RNA, 296 nt, synthetic construct; identical to SEQ ID NO: 52309
  source 1..296: mol_type = other RNA

SEQ ID NO: 52311 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52312 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52313 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52314 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52315 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcaggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52316 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggaggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52317 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgaggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52318 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52319 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcagggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52320 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52321 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgagggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52322 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52323 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcaggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52324 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcaggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52325 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52326 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52327 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcagggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52328 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52329 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaggctgaaggaatattttgcttgtgtgtctagcggcaatagtaacgctaacagccgcgggccgagcttcagcagcggcctggtgccgttaagcttgcgcgagacgtcggaagagc

SEQ ID NO: 52330 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaggaaggaatattttgcttgtgtgtctagcggcaatagtaacgctaacagccgcgggccgagcttcagcagcggcctggtgccgttaagcttgcgcgagacgtcggaagagc

SEQ ID NO: 52331 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagagggaatattttgcttgtgtgtctagcggcaatagtaacgctaacagccgcgggccgagcttcagcagcggcctggtgccgttaagcttgcgcgagacgtcggaagagc

SEQ ID NO: 52332 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaaggtattttgcttgtgtgtctagcggcaatagtaacgctaacagccgcgggccgagcttcagcagcggcctggtgccgttaagcttgcgcgagacgtcggaagagc

SEQ ID NO: 52333 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatataggtttgcttgtgtgtctagcggcaatagtaacgctaacagccgcgggccgagcttcagcagcggcctggtgccgttaagcttgcgcgagacgtcggaagagc

SEQ ID NO: 52334 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttagggcttgtgtgtctagcggcaatagtaacgctaacagccgcgggccgagcttcagcagcggcctggtgccgttaagcttgcgcgagacgtcggaagagc

SEQ ID NO: 52335 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctaggtgtgtgtctagcggcaatagtaacgctaacagccgcgggccgagcttcagcagcggcctggtgccgttaagcttgcgcgagacgtcggaagagc

SEQ ID NO: 52336 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtagggtgtctagcggcaatagtaacgctaacagccgcgggccgagcttcagcagcggcctggtgccgttaagcttgcgcgagacgtcggaagagc

SEQ ID NO: 52337 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgaggtctagcggcaatagtaacgctaacagccgcgggccgagcttcagcagcggcctggtgccgttaagcttgcgcgagacgtcggaagagc

SEQ ID NO: 52338 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaggagcggcaatagtaacgctaacagccgcgggccgagcttcagcagcggcctggtgccgttaagcttgcgcgagacgtcggaagagc

SEQ ID NO: 52339 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaggggcaatagtaacgctaacagccgcgggccgagcttcagcagcggcctggtgccgttaagcttgcgcgagacgtcggaagagc

SEQ ID NO: 52340 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaggaatagtaacgctaacagccgcgggccgagcttcagcagcggcctggtgccgttaagcttgcgcgagacgtcggaagagc

SEQ ID NO: 52341 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataggagtaacgctaacagccgcgggccgagcttcagcagcggcctggtgccgttaagcttgcgcgagacgtcggaagagc

SEQ ID NO: 52342 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaggaacgctaacagccgcgggccgagcttcagcagcggcctggtgccgttaagcttgcgcgagacgtcggaagagc

SEQ ID NO: 52343 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacagggctaacagccgcgggccgagcttcagcagcggcctggtgccgttaagcttgcgcgagacgtcggaagagc

SEQ ID NO: 52344 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaggaacagccgcgggccgagcttcagcagcggcctggtgccgttaagcttgcgcgagacgtcggaagagc

SEQ ID NO: 52345 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaggagccgcgggccgagcttcagcagcggcctggtgccgttaagcttgcgcgagacgtcggaagagc

SEQ ID NO: 52346 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcaggcgcgggccgagcttcagcagcggcctggtgccgttaagcttgcgcgagacgtcggaagagc

SEQ ID NO: 52347 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcagggggccgagcttcagcagcggcctggtgccgttaagcttgcgcgagacgtcggaagagc

SEQ ID NO: 52348 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaggccgagcttcagcagcggcctggtgccgttaagcttgcgcgagacgtcggaagagc

SEQ ID NO: 52349 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaggagcttcagcagcggcctggtgccgttaagcttgcgcgagacgtcggaagagc

SEQ ID NO: 52350 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaggttcagcagcggcctggtgccgttaagcttgcgcgagacgtcggaagagc

SEQ ID NO: 52351 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaggagcagcggcctggtgccgttaagcttgcgcgagacgtcggaagagc

SEQ ID NO: 52352 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaggagcggcctggtgccgttaagcttgcgcgagacgtcggaagagc

SEQ ID NO: 52353 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaggggcctggtgccgttaagcttgcgcgagacgtcggaagagc

SEQ ID NO: 52354 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaggctggtgccgttaagcttgcgcgagacgtcggaagagc

SEQ ID NO: 52355 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgagggtgccgttaagcttgcgcgagacgtcggaagagc

SEQ ID NO: 52356 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaggccgttaagcttgcgcgagacgtcggaagagc

SEQ ID NO: 52357 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaggttaagcttgcgcgagacgtcggaagagc

SEQ ID NO: 52358 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaggagcttgcgcgagacgtcggaagagc

SEQ ID NO: 52359 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcaggttgcgcgagacgtcggaagagc

SEQ ID NO: 52360 - RNA, 296 nt, synthetic construct
  source 1..296: mol_type = other RNA
cgctcttccgcgtctcgtcttcatgagcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52361 - RNA, 296 nt, synthetic construct
  source 1..296: mol_type = other RNA
cgctcttccgcgtctcgtcttcatgaacagcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52362 - RNA, 296 nt, synthetic construct
  source 1..296: mol_type = other RNA
cgctcttccgcgtctcgtcttcatgaacgagagcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52363 - RNA, 296 nt, synthetic construct
  source 1..296: mol_type = other RNA
cgctcttccgcgtctcgtcttcatgaacgagaagagcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52364 - RNA, 296 nt, synthetic construct
  source 1..296: mol_type = other RNA
cgctcttccgcgtctcgtcttcatgaacgagaaggagagcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52365 - RNA, 296 nt, synthetic construct
  source 1..296: mol_type = other RNA
cgctcttccgcgtctcgtcttcatgaacgagaaggaggacagcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52366 - RNA, 296 nt, synthetic construct
  source 1..296: mol_type = other RNA
cgctcttccgcgtctcgtcttcatgaacgagaaggaggacatcagcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52367 - RNA, 296 nt, synthetic construct
  source 1..296: mol_type = other RNA
cgctcttccgcgtctcgtcttcatgaacgagaaggaggacatcctgagctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52368 - RNA, 296 nt, synthetic construct
  source 1..296: mol_type = other RNA
cgctcttccgcgtctcgtcttcatgaacgagaaggaggacatcctgtggagctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52369 - RNA, 296 nt, synthetic construct
  source 1..296: mol_type = other RNA
cgctcttccgcgtctcgtcttcatgaacgagaaggaggacatcctgtggtgcagcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52370 - RNA, 296 nt, synthetic construct
  source 1..296: mol_type = other RNA
cgctcttccgcgtctcgtcttcatgaacgagaaggaggacatcctgtggtgcactagcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52371 - RNA, 296 nt, synthetic construct
  source 1..296: mol_type = other RNA
cgctcttccgcgtctcgtcttcatgaacgagaaggaggacatcctgtggtgcactgaaagcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52372 - RNA, 296 nt, synthetic construct
  source 1..296: mol_type = other RNA
cgctcttccgcgtctcgtcttcatgaacgagaaggaggacatcctgtggtgcactgaaatgagcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52373 - RNA, 296 nt, synthetic construct
  source 1..296: mol_type = other RNA
cgctcttccgcgtctcgtcttcatgaacgagaaggaggacatcctgtggtgcactgaaatggaaagcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52374 - RNA, 296 nt, synthetic construct
  source 1..296: mol_type = other RNA
cgctcttccgcgtctcgtcttcatgaacgagaaggaggacatcctgtggtgcactgaaatggaaaggagcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52375 - RNA, 296 nt, synthetic construct
  source 1..296: mol_type = other RNA
cgctcttccgcgtctcgtcttcatgaacgagaaggaggacatcctgtggtgcactgaaatggaaagggtgagctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52376 - RNA, 296 nt, synthetic construct
  source 1..296: mol_type = other RNA
cgctcttccgcgtctcgtcttcatgaacgagaaggaggacatcctgtggtgcactgaaatggaaagggtgtttagcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52377 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcagcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52378 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcagccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52379 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccagcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52380 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcagccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52381 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacagctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52382 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacagcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52383 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaagcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52384 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacagcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52385 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgagctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52386 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccagcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52387 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacagcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52388 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52389 - RNA, 296 nt, synthetic construct; identical to SEQ ID NO: 52388
  source 1..296: mol_type = other RNA

SEQ ID NO: 52390 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcagcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52391 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgagcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52392 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52393 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggagccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52394 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52395 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaagcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52396 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgagcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52397 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgagcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52398 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcagccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52399 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggagctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52400 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgagctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52401 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52402 - RNA, 296 nt, synthetic construct; identical to SEQ ID NO: 52401
  source 1..296: mol_type = other RNA

SEQ ID NO: 52403 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgagcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52404 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgagcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52405 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcagcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52406 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcagccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52407 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcagccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52408 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacagcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52409 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcagcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52410 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcagcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52411 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctagcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52412 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgagcctgaaggaatattttgcttgtgtgtctagcggcaatagtaacgctaacagccgcgggccgagcttcagcagcggcctggtgccgttaagcttgcgcgagacgtcggaagagc

SEQ ID NO: 52413 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgagcaaggaatattttgcttgtgtgtctagcggcaatagtaacgctaacagccgcgggccgagcttcagcagcggcctggtgccgttaagcttgcgcgagacgtcggaagagc

SEQ ID NO: 52414 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagagcgaatattttgcttgtgtgtctagcggcaatagtaacgctaacagccgcgggccgagcttcagcagcggcctggtgccgttaagcttgcgcgagacgtcggaagagc

SEQ ID NO: 52415 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaagctattttgcttgtgtgtctagcggcaatagtaacgctaacagccgcgggccgagcttcagcagcggcctggtgccgttaagcttgcgcgagacgtcggaagagc

SEQ ID NO: 52416 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatagctttgcttgtgtgtctagcggcaatagtaacgctaacagccgcgggccgagcttcagcagcggcctggtgccgttaagcttgcgcgagacgtcggaagagc

SEQ ID NO: 52417 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttagcgcttgtgtgtctagcggcaatagtaacgctaacagccgcgggccgagcttcagcagcggcctggtgccgttaagcttgcgcgagacgtcggaagagc

SEQ ID NO: 52418 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctagctgtgtgtctagcggcaatagtaacgctaacagccgcgggccgagcttcagcagcggcctggtgccgttaagcttgcgcgagacgtcggaagagc

SEQ ID NO: 52419 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtagcgtgtctagcggcaatagtaacgctaacagccgcgggccgagcttcagcagcggcctggtgccgttaagcttgcgcgagacgtcggaagagc

SEQ ID NO: 52420 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgagctctagcggcaatagtaacgctaacagccgcgggccgagcttcagcagcggcctggtgccgttaagcttgcgcgagacgtcggaagagc

SEQ ID NO: 52421 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcagcggcaatagtaacgctaacagccgcgggccgagcttcagcagcggcctggtgccgttaagcttgcgcgagacgtcggaagagc

SEQ ID NO: 52422 - RNA, 296 nt, synthetic construct; identical to SEQ ID NO: 52421
  source 1..296: mol_type = other RNA

SEQ ID NO: 52423 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcagcaatagtaacgctaacagccgcgggccgagcttcagcagcggcctggtgccgttaagcttgcgcgagacgtcggaagagc

SEQ ID NO: 52424 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagcagtaacgctaacagccgcgggccgagcttcagcagcggcctggtgccgttaagcttgcgcgagacgtcggaagagc

SEQ ID NO: 52425 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtagcaacgctaacagccgcgggccgagcttcagcagcggcctggtgccgttaagcttgcgcgagacgtcggaagagc

SEQ ID NO: 52426 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacagcgctaacagccgcgggccgagcttcagcagcggcctggtgccgttaagcttgcgcgagacgtcggaagagc

SEQ ID NO: 52427 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctagcaacagccgcgggccgagcttcagcagcggcctggtgccgttaagcttgcgcgagacgtcggaagagc

SEQ ID NO: 52428 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcagccgcgggccgagcttcagcagcggcctggtgccgttaagcttgcgcgagacgtcggaagagc

SEQ ID NO: 52429 - RNA, 296 nt, synthetic construct; identical to SEQ ID NO: 52428
  source 1..296: mol_type = other RNA

SEQ ID NO: 52430 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcagcgggccgagcttcagcagcggcctggtgccgttaagcttgcgcgagacgtcggaagagc

SEQ ID NO: 52431 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggagcccgagcttcagcagcggcctggtgccgttaagcttgcgcgagacgtcggaagagc

SEQ ID NO: 52432 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcagcttcagcagcggcctggtgccgttaagcttgcgcgagacgtcggaagagc

SEQ ID NO: 52433 - RNA, 296 nt, synthetic construct; identical to SEQ ID NO: 52432
  source 1..296: mol_type = other RNA

SEQ ID NO: 52434 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcagcggcctggtgccgttaagcttgcgcgagacgtcggaagagc

SEQ ID NO: 52435 - RNA, 296 nt, synthetic construct; identical to SEQ ID NO: 52434
  source 1..296: mol_type = other RNA

SEQ ID NO: 52436 - RNA, 296 nt, synthetic construct; identical to SEQ ID NO: 52434
  source 1..296: mol_type = other RNA

SEQ ID NO: 52437 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcagcctggtgccgttaagcttgcgcgagacgtcggaagagc

SEQ ID NO: 52438 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgagcgtgccgttaagcttgcgcgagacgtcggaagagc

SEQ ID NO: 52439 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgagcccgttaagcttgcgcgagacgtcggaagagc

SEQ ID NO: 52440 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgagcttaagcttgcgcgagacgtcggaagagc

SEQ ID NO: 52441 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcagcttgcgcgagacgtcggaagagc

SEQ ID NO: 52442 - RNA, 296 nt, synthetic construct; identical to SEQ ID NO: 52441
  source 1..296: mol_type = other RNA

SEQ ID NO: 52443 - RNA, 296 nt, synthetic construct
  source 1..296: mol_type = other RNA
cgctcttccgcgtctcgtcttcatgacgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52444 - RNA, 296 nt, synthetic construct
  source 1..296: mol_type = other RNA
cgctcttccgcgtctcgtcttcatgaacacggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52445 - RNA, 296 nt, synthetic construct
  source 1..296: mol_type = other RNA
cgctcttccgcgtctcgtcttcatgaacgagacgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52446 - RNA, 296 nt, synthetic construct
  source 1..296: mol_type = other RNA
cgctcttccgcgtctcgtcttcatgaacgagaagacggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52447 - RNA, 296 nt, synthetic construct
  source 1..296: mol_type = other RNA
cgctcttccgcgtctcgtcttcatgaacgagaaggagacggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52448 - RNA, 296 nt, synthetic construct
  source 1..296: mol_type = other RNA
cgctcttccgcgtctcgtcttcatgaacgagaaggaggacacgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52449 - RNA, 296 nt, synthetic construct
  source 1..296: mol_type = other RNA
cgctcttccgcgtctcgtcttcatgaacgagaaggaggacatcacgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52450 - RNA, 296 nt, synthetic construct
  source 1..296: mol_type = other RNA
cgctcttccgcgtctcgtcttcatgaacgagaaggaggacatcctgacgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52451 - RNA, 296 nt, synthetic construct
  source 1..296: mol_type = other RNA
cgctcttccgcgtctcgtcttcatgaacgagaaggaggacatcctgtggacgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52452 - RNA, 296 nt, synthetic construct
  source 1..296: mol_type = other RNA
cgctcttccgcgtctcgtcttcatgaacgagaaggaggacatcctgtggtgcacgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52453 - RNA, 296 nt, synthetic construct
  source 1..296: mol_type = other RNA
cgctcttccgcgtctcgtcttcatgaacgagaaggaggacatcctgtggtgcactacggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52454 - RNA, 296 nt, synthetic construct
  source 1..296: mol_type = other RNA
cgctcttccgcgtctcgtcttcatgaacgagaaggaggacatcctgtggtgcactgaaacgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52455 - RNA, 296 nt, synthetic construct
  source 1..296: mol_type = other RNA
cgctcttccgcgtctcgtcttcatgaacgagaaggaggacatcctgtggtgcactgaaatgacggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52456 - RNA, 296 nt, synthetic construct
  source 1..296: mol_type = other RNA
cgctcttccgcgtctcgtcttcatgaacgagaaggaggacatcctgtggtgcactgaaatggaaacgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52457 - RNA, 296 nt, synthetic construct
  source 1..296: mol_type = other RNA
cgctcttccgcgtctcgtcttcatgaacgagaaggaggacatcctgtggtgcactgaaatggaaaggacggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52458 - RNA, 296 nt, synthetic construct
  source 1..296: mol_type = other RNA
cgctcttccgcgtctcgtcttcatgaacgagaaggaggacatcctgtggtgcactgaaatggaaagggtgacgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52459 - RNA, 296 nt, synthetic construct
  source 1..296: mol_type = other RNA
cgctcttccgcgtctcgtcttcatgaacgagaaggaggacatcctgtggtgcactgaaatggaaagggtgtttacgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52460 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcacgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52461 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcacgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52462 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccacggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52463 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcacgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52464 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacacgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52465 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52466 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaacggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52467 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacacggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52468 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgacgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52469 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccacgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52470 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacacgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52471 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgacgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52472 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcacgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52473 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcacgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52474 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgacggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52475 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgacgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52476 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggacgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52477 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagacgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52478 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaacgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52479 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgacgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52480 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgacgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52481 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcacgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52482 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggacgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52483 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgacgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52484 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggacgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52485 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcacggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52486 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgacgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52487 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgacggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52488 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcacgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52489 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcacgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52490 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcacgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52491 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacacgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52492 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcacgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52493 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcacggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52494 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctacgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52495 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgacgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52496 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgacgaaggaatattttgcttgtgtgtctagcggcaatagtaacgctaacagccgcgggccgagcttcagcagcggcctggtgccgttaagcttgcgcgagacgtcggaagagc

SEQ ID NO: 52497 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagacggaatattttgcttgtgtgtctagcggcaatagtaacgctaacagccgcgggccgagcttcagcagcggcctggtgccgttaagcttgcgcgagacgtcggaagagc

SEQ ID NO: 52498 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaacgtattttgcttgtgtgtctagcggcaatagtaacgctaacagccgcgggccgagcttcagcagcggcctggtgccgttaagcttgcgcgagacgtcggaagagc

SEQ ID NO: 52499 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatacgtttgcttgtgtgtctagcggcaatagtaacgctaacagccgcgggccgagcttcagcagcggcctggtgccgttaagcttgcgcgagacgtcggaagagc

SEQ ID NO: 52500 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttacggcttgtgtgtctagcggcaatagtaacgctaacagccgcgggccgagcttcagcagcggcctggtgccgttaagcttgcgcgagacgtcggaagagc

SEQ ID NO: 52501 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctacgtgtgtgtctagcggcaatagtaacgctaacagccgcgggccgagcttcagcagcggcctggtgccgttaagcttgcgcgagacgtcggaagagc

SEQ ID NO: 52502 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtacggtgtctagcggcaatagtaacgctaacagccgcgggccgagcttcagcagcggcctggtgccgttaagcttgcgcgagacgtcggaagagc

SEQ ID NO: 52503 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgacgtctagcggcaatagtaacgctaacagccgcgggccgagcttcagcagcggcctggtgccgttaagcttgcgcgagacgtcggaagagc

SEQ ID NO: 52504 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctacgagcggcaatagtaacgctaacagccgcgggccgagcttcagcagcggcctggtgccgttaagcttgcgcgagacgtcggaagagc

SEQ ID NO: 52505 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcacgggcaatagtaacgctaacagccgcgggccgagcttcagcagcggcctggtgccgttaagcttgcgcgagacgtcggaagagc

SEQ ID NO: 52506 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcacgaatagtaacgctaacagccgcgggccgagcttcagcagcggcctggtgccgttaagcttgcgcgagacgtcggaagagc

SEQ ID NO: 52507 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatacgagtaacgctaacagccgcgggccgagcttcagcagcggcctggtgccgttaagcttgcgcgagacgtcggaagagc

SEQ ID NO: 52508 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtacgaacgctaacagccgcgggccgagcttcagcagcggcctggtgccgttaagcttgcgcgagacgtcggaagagc

SEQ ID NO: 52509 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacacggctaacagccgcgggccgagcttcagcagcggcctggtgccgttaagcttgcgcgagacgtcggaagagc

SEQ ID NO: 52510 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctacgaacagccgcgggccgagcttcagcagcggcctggtgccgttaagcttgcgcgagacgtcggaagagc

SEQ ID NO: 52511 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacacgagccgcgggccgagcttcagcagcggcctggtgccgttaagcttgcgcgagacgtcggaagagc

SEQ ID NO: 52512 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcacgcgcgggccgagcttcagcagcggcctggtgccgttaagcttgcgcgagacgtcggaagagc

SEQ ID NO: 52513 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcacggggccgagcttcagcagcggcctggtgccgttaagcttgcgcgagacgtcggaagagc

SEQ ID NO: 52514 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggacgccgagcttcagcagcggcctggtgccgttaagcttgcgcgagacgtcggaagagc

SEQ ID NO: 52515 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgacgagcttcagcagcggcctggtgccgttaagcttgcgcgagacgtcggaagagc

SEQ ID NO: 52516 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcacgttcagcagcggcctggtgccgttaagcttgcgcgagacgtcggaagagc

SEQ ID NO: 52517 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcacgagcagcggcctggtgccgttaagcttgcgcgagacgtcggaagagc

SEQ ID NO: 52518 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcacgagcggcctggtgccgttaagcttgcgcgagacgtcggaagagc

SEQ ID NO: 52519 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcacgggcctggtgccgttaagcttgcgcgagacgtcggaagagc

SEQ ID NO: 52520 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcacgctggtgccgttaagcttgcgcgagacgtcggaagagc

SEQ ID NO: 52521 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgacggtgccgttaagcttgcgcgagacgtcggaagagc

SEQ ID NO: 52522 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgacgccgttaagcttgcgcgagacgtcggaagagc

SEQ ID NO: 52523 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgacgttaagcttgcgcgagacgtcggaagagc

SEQ ID NO: 52524 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaacgagcttgcgcgagacgtcggaagagc

SEQ ID NO: 52525 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcacgttgcgcgagacgtcggaagagc

SEQ ID NO: 52526 - RNA, 296 nt, synthetic construct
  source 1..296: mol_type = other RNA
cgctcttccgcgtctcgtcttcatgaccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52527 - RNA, 296 nt, synthetic construct
  source 1..296: mol_type = other RNA
cgctcttccgcgtctcgtcttcatgaacaccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52528 - RNA, 296 nt, synthetic construct
  source 1..296: mol_type = other RNA
cgctcttccgcgtctcgtcttcatgaacgagaccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52529 - RNA, 296 nt, synthetic construct
  source 1..296: mol_type = other RNA
cgctcttccgcgtctcgtcttcatgaacgagaagaccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52530 - RNA, 296 nt, synthetic construct
  source 1..296: mol_type = other RNA
cgctcttccgcgtctcgtcttcatgaacgagaaggagaccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52531 - RNA, 296 nt, synthetic construct
  source 1..296: mol_type = other RNA
cgctcttccgcgtctcgtcttcatgaacgagaaggaggacaccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52532 - RNA, 296 nt, synthetic construct
  source 1..296: mol_type = other RNA
cgctcttccgcgtctcgtcttcatgaacgagaaggaggacatcaccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52533 - RNA, 296 nt, synthetic construct
  source 1..296: mol_type = other RNA
cgctcttccgcgtctcgtcttcatgaacgagaaggaggacatcctgacctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52534 - RNA, 296 nt, synthetic construct
  source 1..296: mol_type = other RNA
cgctcttccgcgtctcgtcttcatgaacgagaaggaggacatcctgtggacctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52535 - RNA, 296 nt, synthetic construct
  source 1..296: mol_type = other RNA
cgctcttccgcgtctcgtcttcatgaacgagaaggaggacatcctgtggtgcaccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52536 - RNA, 296 nt, synthetic construct
  source 1..296: mol_type = other RNA
cgctcttccgcgtctcgtcttcatgaacgagaaggaggacatcctgtggtgcactaccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52537 - RNA, 296 nt, synthetic construct
  source 1..296: mol_type = other RNA
cgctcttccgcgtctcgtcttcatgaacgagaaggaggacatcctgtggtgcactgaaaccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52538 - RNA, 296 nt, synthetic construct
  source 1..296: mol_type = other RNA
cgctcttccgcgtctcgtcttcatgaacgagaaggaggacatcctgtggtgcactgaaatgaccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52539 - RNA, 296 nt, synthetic construct
  source 1..296: mol_type = other RNA
cgctcttccgcgtctcgtcttcatgaacgagaaggaggacatcctgtggtgcactgaaatggaaaccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52540 - RNA, 296 nt, synthetic construct
  source 1..296: mol_type = other RNA
cgctcttccgcgtctcgtcttcatgaacgagaaggaggacatcctgtggtgcactgaaatggaaaggaccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52541 - RNA, 296 nt, synthetic construct
  source 1..296: mol_type = other RNA
cgctcttccgcgtctcgtcttcatgaacgagaaggaggacatcctgtggtgcactgaaatggaaagggtgacctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52542 - RNA, 296 nt, synthetic construct
  source 1..296: mol_type = other RNA
cgctcttccgcgtctcgtcttcatgaacgagaaggaggacatcctgtggtgcactgaaatggaaagggtgtttaccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52543 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcaccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52544 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcacccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52545 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccaccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52546 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcacccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52547 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacacctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52548 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacaccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52549 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaaccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52550 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacaccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52551 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgacctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52552 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52553 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacaccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52554 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgaccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52555 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcacccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52556 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcaccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52557 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52558 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52559 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggacccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52560 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagaccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52561 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaaccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52562 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgaccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52563 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgaccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52564 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcacccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52565 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggacctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52566 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgacctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52567 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggaccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52568 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcaccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52569 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgaccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52570 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgaccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52571 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcaccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52572 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcacccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52573 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcacccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52574 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacaccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52575 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcaccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52576 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcaccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52577 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctaccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52578 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaccctgaaggaatattttgcttgtgtgtctagcggcaatagtaacgctaacagccgcgggccgagcttcagcagcggcctggtgccgttaagcttgcgcgagacgtcggaagagc

SEQ ID NO: 52579 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaccaaggaatattttgcttgtgtgtctagcggcaatagtaacgctaacagccgcgggccgagcttcagcagcggcctggtgccgttaagcttgcgcgagacgtcggaagagc

SEQ ID NO: 52580 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagaccgaatattttgcttgtgtgtctagcggcaatagtaacgctaacagccgcgggccgagcttcagcagcggcctggtgccgttaagcttgcgcgagacgtcggaagagc

SEQ ID NO: 52581 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaacctattttgcttgtgtgtctagcggcaatagtaacgctaacagccgcgggccgagcttcagcagcggcctggtgccgttaagcttgcgcgagacgtcggaagagc

SEQ ID NO: 52582 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatacctttgcttgtgtgtctagcggcaatagtaacgctaacagccgcgggccgagcttcagcagcggcctggtgccgttaagcttgcgcgagacgtcggaagagc

SEQ ID NO: 52583 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttaccgcttgtgtgtctagcggcaatagtaacgctaacagccgcgggccgagcttcagcagcggcctggtgccgttaagcttgcgcgagacgtcggaagagc

SEQ ID NO: 52584 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctacctgtgtgtctagcggcaatagtaacgctaacagccgcgggccgagcttcagcagcggcctggtgccgttaagcttgcgcgagacgtcggaagagc

SEQ ID NO: 52585 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtaccgtgtctagcggcaatagtaacgctaacagccgcgggccgagcttcagcagcggcctggtgccgttaagcttgcgcgagacgtcggaagagc

SEQ ID NO: 52586 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgacctctagcggcaatagtaacgctaacagccgcgggccgagcttcagcagcggcctggtgccgttaagcttgcgcgagacgtcggaagagc

SEQ ID NO: 52587 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctaccagcggcaatagtaacgctaacagccgcgggccgagcttcagcagcggcctggtgccgttaagcttgcgcgagacgtcggaagagc

SEQ ID NO: 52588 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaccggcaatagtaacgctaacagccgcgggccgagcttcagcagcggcctggtgccgttaagcttgcgcgagacgtcggaagagc

SEQ ID NO: 52589 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaccaatagtaacgctaacagccgcgggccgagcttcagcagcggcctggtgccgttaagcttgcgcgagacgtcggaagagc

SEQ ID NO: 52590 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataccagtaacgctaacagccgcgggccgagcttcagcagcggcctggtgccgttaagcttgcgcgagacgtcggaagagc

SEQ ID NO: 52591 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaccaacgctaacagccgcgggccgagcttcagcagcggcctggtgccgttaagcttgcgcgagacgtcggaagagc

SEQ ID NO: 52592 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaccgctaacagccgcgggccgagcttcagcagcggcctggtgccgttaagcttgcgcgagacgtcggaagagc

SEQ ID NO: 52593 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaccaacagccgcgggccgagcttcagcagcggcctggtgccgttaagcttgcgcgagacgtcggaagagc

SEQ ID NO: 52594 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacaccagccgcgggccgagcttcagcagcggcctggtgccgttaagcttgcgcgagacgtcggaagagc

SEQ ID NO: 52595 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcacccgcgggccgagcttcagcagcggcctggtgccgttaagcttgcgcgagacgtcggaagagc

SEQ ID NO: 52596 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcaccgggccgagcttcagcagcggcctggtgccgttaagcttgcgcgagacgtcggaagagc

SEQ ID NO: 52597 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggaccccgagcttcagcagcggcctggtgccgttaagcttgcgcgagacgtcggaagagc

SEQ ID NO: 52598 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgaccagcttcagcagcggcctggtgccgttaagcttgcgcgagacgtcggaagagc

SEQ ID NO: 52599 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcaccttcagcagcggcctggtgccgttaagcttgcgcgagacgtcggaagagc

SEQ ID NO: 52600 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcaccagcagcggcctggtgccgttaagcttgcgcgagacgtcggaagagc

SEQ ID NO: 52601 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcaccagcggcctggtgccgttaagcttgcgcgagacgtcggaagagc

SEQ ID NO: 52602 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcaccggcctggtgccgttaagcttgcgcgagacgtcggaagagc

SEQ ID NO: 52603 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcaccctggtgccgttaagcttgcgcgagacgtcggaagagc

SEQ ID NO: 52604 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgaccgtgccgttaagcttgcgcgagacgtcggaagagc

SEQ ID NO: 52605 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgaccccgttaagcttgcgcgagacgtcggaagagc

SEQ ID NO: 52606 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgaccttaagcttgcgcgagacgtcggaagagc

SEQ ID NO: 52607 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaaccagcttgcgcgagacgtcggaagagc

SEQ ID NO: 52608 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcaccttgcgcgagacgtcggaagagc

SEQ ID NO: 52609 - RNA, 296 nt, synthetic construct
  source 1..296: mol_type = other RNA
cgctcttccgcgtctcgtcttcatgtagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52610 - RNA, 296 nt, synthetic construct
  source 1..296: mol_type = other RNA
cgctcttccgcgtctcgtcttcatgaactaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52611 - RNA, 296 nt, synthetic construct
  source 1..296: mol_type = other RNA
cgctcttccgcgtctcgtcttcatgaacgagtagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52612 - RNA, 296 nt, synthetic construct
  source 1..296: mol_type = other RNA
cgctcttccgcgtctcgtcttcatgaacgagaagtaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52613 - RNA, 296 nt, synthetic construct
  source 1..296: mol_type = other RNA
cgctcttccgcgtctcgtcttcatgaacgagaaggagtaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52614 - RNA, 296 nt, synthetic construct
  source 1..296: mol_type = other RNA
cgctcttccgcgtctcgtcttcatgaacgagaaggaggactagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52615 - RNA, 296 nt, synthetic construct
  source 1..296: mol_type = other RNA
cgctcttccgcgtctcgtcttcatgaacgagaaggaggacatctagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52616 - RNA, 296 nt, synthetic construct
  source 1..296: mol_type = other RNA
cgctcttccgcgtctcgtcttcatgaacgagaaggaggacatcctgtagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52617 - RNA, 296 nt, synthetic construct
  source 1..296: mol_type = other RNA
cgctcttccgcgtctcgtcttcatgaacgagaaggaggacatcctgtggtagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52618 - RNA, 296 nt, synthetic construct
  source 1..296: mol_type = other RNA
cgctcttccgcgtctcgtcttcatgaacgagaaggaggacatcctgtggtgctagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52619 - RNA, 296 nt, synthetic construct
  source 1..296: mol_type = other RNA
cgctcttccgcgtctcgtcttcatgaacgagaaggaggacatcctgtggtgcacttaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52620 - RNA, 296 nt, synthetic construct
  source 1..296: mol_type = other RNA
cgctcttccgcgtctcgtcttcatgaacgagaaggaggacatcctgtggtgcactgaatagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52621 - RNA, 296 nt, synthetic construct
  source 1..296: mol_type = other RNA
cgctcttccgcgtctcgtcttcatgaacgagaaggaggacatcctgtggtgcactgaaatgtaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52622 - RNA, 296 nt, synthetic construct
  source 1..296: mol_type = other RNA
cgctcttccgcgtctcgtcttcatgaacgagaaggaggacatcctgtggtgcactgaaatggaatagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52623 - RNA, 296 nt, synthetic construct
  source 1..296: mol_type = other RNA
cgctcttccgcgtctcgtcttcatgaacgagaaggaggacatcctgtggtgcactgaaatggaaaggtaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52624 - RNA, 296 nt, synthetic construct
  source 1..296: mol_type = other RNA
cgctcttccgcgtctcgtcttcatgaacgagaaggaggacatcctgtggtgcactgaaatggaaagggtgtagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52625 - RNA, 296 nt, synthetic construct
  source 1..296: mol_type = other RNA
cgctcttccgcgtctcgtcttcatgaacgagaaggaggacatcctgtggtgcactgaaatggaaagggtgttttagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52626 - RNA, 296 nt, synthetic construct
  source 1..296: mol_type = other RNA
cgctcttccgcgtctcgtcttcatgaacgagaaggaggacatcctgtggtgcactgaaatggaaagggtgtttggctagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52627 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttctagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52628 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccctaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52629 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtctagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52630 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52631 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactactagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52632 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacataggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52633 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagactaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52634 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52635 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcctagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52636 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaactagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52637 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgtagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52638 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagctagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52639 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgctagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52640 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52641 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52642 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52643 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52644 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52645 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52646 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52647 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52648 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52649 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52650 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52651 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52652 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52653 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52654 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52655 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52656 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52657 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52658 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52659 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52660 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52661 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtagctgaaggaatattttgcttgtgtgtctagcggcaatagtaacgctaacagccgcgggccgagcttcagcagcggcctggtgccgttaagcttgcgcgagacgtcggaagagc

SEQ ID NO: 52662 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtagaaggaatattttgcttgtgtgtctagcggcaatagtaacgctaacagccgcgggccgagcttcagcagcggcctggtgccgttaagcttgcgcgagacgtcggaagagc

SEQ ID NO: 52663 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtaggaatattttgcttgtgtgtctagcggcaatagtaacgctaacagccgcgggccgagcttcagcagcggcctggtgccgttaagcttgcgcgagacgtcggaagagc

SEQ ID NO: 52664 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatagtattttgcttgtgtgtctagcggcaatagtaacgctaacagccgcgggccgagcttcagcagcggcctggtgccgttaagcttgcgcgagacgtcggaagagc

SEQ ID NO: 52665 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattagtttgcttgtgtgtctagcggcaatagtaacgctaacagccgcgggccgagcttcagcagcggcctggtgccgttaagcttgcgcgagacgtcggaagagc

SEQ ID NO: 52666 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttaggcttgtgtgtctagcggcaatagtaacgctaacagccgcgggccgagcttcagcagcggcctggtgccgttaagcttgcgcgagacgtcggaagagc

SEQ ID NO: 52667 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttagtgtgtgtctagcggcaatagtaacgctaacagccgcgggccgagcttcagcagcggcctggtgccgttaagcttgcgcgagacgtcggaagagc

SEQ ID NO: 52668 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttaggtgtctagcggcaatagtaacgctaacagccgcgggccgagcttcagcagcggcctggtgccgttaagcttgcgcgagacgtcggaagagc

SEQ ID NO: 52669 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtagtctagcggcaatagtaacgctaacagccgcgggccgagcttcagcagcggcctggtgccgttaagcttgcgcgagacgtcggaagagc

SEQ ID NO: 52670 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttagagcggcaatagtaacgctaacagccgcgggccgagcttcagcagcggcctggtgccgttaagcttgcgcgagacgtcggaagagc

SEQ ID NO: 52671 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctagggcaatagtaacgctaacagccgcgggccgagcttcagcagcggcctggtgccgttaagcttgcgcgagacgtcggaagagc

SEQ ID NO: 52672 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctagaatagtaacgctaacagccgcgggccgagcttcagcagcggcctggtgccgttaagcttgcgcgagacgtcggaagagc

SEQ ID NO: 52673 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattagagtaacgctaacagccgcgggccgagcttcagcagcggcctggtgccgttaagcttgcgcgagacgtcggaagagc

SEQ ID NO: 52674 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttagaacgctaacagccgcgggccgagcttcagcagcggcctggtgccgttaagcttgcgcgagacgtcggaagagc

SEQ ID NO: 52675 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactaggctaacagccgcgggccgagcttcagcagcggcctggtgccgttaagcttgcgcgagacgtcggaagagc

SEQ ID NO: 52676 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttagaacagccgcgggccgagcttcagcagcggcctggtgccgttaagcttgcgcgagacgtcggaagagc

SEQ ID NO: 52677 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactagagccgcgggccgagcttcagcagcggcctggtgccgttaagcttgcgcgagacgtcggaagagc

SEQ ID NO: 52678 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctagcgcgggccgagcttcagcagcggcctggtgccgttaagcttgcgcgagacgtcggaagagc

SEQ ID NO: 52679 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctaggggccgagcttcagcagcggcctggtgccgttaagcttgcgcgagacgtcggaagagc

SEQ ID NO: 52680 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtagccgagcttcagcagcggcctggtgccgttaagcttgcgcgagacgtcggaagagc

SEQ ID NO: 52681 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtagagcttcagcagcggcctggtgccgttaagcttgcgcgagacgtcggaagagc

SEQ ID NO: 52682 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctagttcagcagcggcctggtgccgttaagcttgcgcgagacgtcggaagagc

SEQ ID NO: 52683 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctagagcagcggcctggtgccgttaagcttgcgcgagacgtcggaagagc

SEQ ID NO: 52684 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctagagcggcctggtgccgttaagcttgcgcgagacgtcggaagagc

SEQ ID NO: 52685 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctagggcctggtgccgttaagcttgcgcgagacgtcggaagagc

SEQ ID NO: 52686 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctagctggtgccgttaagcttgcgcgagacgtcggaagagc

SEQ ID NO: 52687 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtaggtgccgttaagcttgcgcgagacgtcggaagagc

SEQ ID NO: 52688 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtagccgttaagcttgcgcgagacgtcggaagagc

SEQ ID NO: 52689 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtagttaagcttgcgcgagacgtcggaagagc

SEQ ID NO: 52690 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatagagcttgcgcgagacgtcggaagagc

SEQ ID NO: 52691 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagctagttgcgcgagacgtcggaagagc

SEQ ID NO: 52692 - RNA, 296 nt, synthetic construct
  source 1..296: mol_type = other RNA
cgctcttccgcgtctcgtcttcatgtacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52693 - RNA, 296 nt, synthetic construct
  source 1..296: mol_type = other RNA
cgctcttccgcgtctcgtcttcatgaactacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52694 - RNA, 296 nt, synthetic construct
  source 1..296: mol_type = other RNA
cgctcttccgcgtctcgtcttcatgaacgagtacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52695 - RNA, 296 nt, synthetic construct
  source 1..296: mol_type = other RNA
cgctcttccgcgtctcgtcttcatgaacgagaagtacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52696 - RNA, 296 nt, synthetic construct
  source 1..296: mol_type = other RNA
cgctcttccgcgtctcgtcttcatgaacgagaaggagtacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52697 - RNA, 296 nt, synthetic construct
  source 1..296: mol_type = other RNA
cgctcttccgcgtctcgtcttcatgaacgagaaggaggactacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52698 - RNA, 296 nt, synthetic construct
  source 1..296: mol_type = other RNA
cgctcttccgcgtctcgtcttcatgaacgagaaggaggacatctacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52699 - RNA, 296 nt, synthetic construct
  source 1..296: mol_type = other RNA
cgctcttccgcgtctcgtcttcatgaacgagaaggaggacatcctgtactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52700 - RNA, 296 nt, synthetic construct
  source 1..296: mol_type = other RNA
cgctcttccgcgtctcgtcttcatgaacgagaaggaggacatcctgtggtactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52701 - RNA, 296 nt, synthetic construct
  source 1..296: mol_type = other RNA
cgctcttccgcgtctcgtcttcatgaacgagaaggaggacatcctgtggtgctacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52702 - RNA, 296 nt, synthetic construct
  source 1..296: mol_type = other RNA
cgctcttccgcgtctcgtcttcatgaacgagaaggaggacatcctgtggtgcacttacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52703 - RNA, 296 nt, synthetic construct
  source 1..296: mol_type = other RNA
cgctcttccgcgtctcgtcttcatgaacgagaaggaggacatcctgtggtgcactgaatacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52704 - RNA, 296 nt, synthetic construct
  source 1..296: mol_type = other RNA
cgctcttccgcgtctcgtcttcatgaacgagaaggaggacatcctgtggtgcactgaaatgtacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52705 - RNA, 296 nt, synthetic construct
  source 1..296: mol_type = other RNA
cgctcttccgcgtctcgtcttcatgaacgagaaggaggacatcctgtggtgcactgaaatggaatacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52706 - RNA, 296 nt, synthetic construct
  source 1..296: mol_type = other RNA
cgctcttccgcgtctcgtcttcatgaacgagaaggaggacatcctgtggtgcactgaaatggaaaggtacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52707 - RNA, 296 nt, synthetic construct
  source 1..296: mol_type = other RNA
cgctcttccgcgtctcgtcttcatgaacgagaaggaggacatcctgtggtgcactgaaatggaaagggtgtactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52708 - RNA, 296 nt, synthetic construct
  source 1..296: mol_type = other RNA
cgctcttccgcgtctcgtcttcatgaacgagaaggaggacatcctgtggtgcactgaaatggaaagggtgttttacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52709 - RNA, 296 nt, synthetic construct
  source 1..296: mol_type = other RNA
cgctcttccgcgtctcgtcttcatgaacgagaaggaggacatcctgtggtgcactgaaatggaaagggtgtttggctacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52710 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttctaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52711 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccctacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52712 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtctaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52713 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52714 - RNA, 296 nt, synthetic construct; identical to SEQ ID NO: 52713
  source 1..296: mol_type = other RNA

SEQ ID NO: 52715 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacatacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52716 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagactacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52717 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52718 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcctacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52719 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaactacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52720 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgtacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52721 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagctaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52722 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgctacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52723 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52724 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52725 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52726 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52727 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52728 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52729 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52730 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52731 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52732 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52733 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52734 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52735 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52736 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52737 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52738 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52739 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52740 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52741 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52742 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52743 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52744 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtacctgaaggaatattttgcttgtgtgtctagcggcaatagtaacgctaacagccgcgggccgagcttcagcagcggcctggtgccgttaagcttgcgcgagacgtcggaagagc

SEQ ID NO: 52745 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtacaaggaatattttgcttgtgtgtctagcggcaatagtaacgctaacagccgcgggccgagcttcagcagcggcctggtgccgttaagcttgcgcgagacgtcggaagagc

SEQ ID NO: 52746 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtacgaatattttgcttgtgtgtctagcggcaatagtaacgctaacagccgcgggccgagcttcagcagcggcctggtgccgttaagcttgcgcgagacgtcggaagagc

SEQ ID NO: 52747 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatactattttgcttgtgtgtctagcggcaatagtaacgctaacagccgcgggccgagcttcagcagcggcctggtgccgttaagcttgcgcgagacgtcggaagagc

SEQ ID NO: 52748 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattactttgcttgtgtgtctagcggcaatagtaacgctaacagccgcgggccgagcttcagcagcggcctggtgccgttaagcttgcgcgagacgtcggaagagc

SEQ ID NO: 52749 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttacgcttgtgtgtctagcggcaatagtaacgctaacagccgcgggccgagcttcagcagcggcctggtgccgttaagcttgcgcgagacgtcggaagagc

SEQ ID NO: 52750 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttactgtgtgtctagcggcaatagtaacgctaacagccgcgggccgagcttcagcagcggcctggtgccgttaagcttgcgcgagacgtcggaagagc

SEQ ID NO: 52751 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttacgtgtctagcggcaatagtaacgctaacagccgcgggccgagcttcagcagcggcctggtgccgttaagcttgcgcgagacgtcggaagagc

SEQ ID NO: 52752 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtactctagcggcaatagtaacgctaacagccgcgggccgagcttcagcagcggcctggtgccgttaagcttgcgcgagacgtcggaagagc

SEQ ID NO: 52753 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttacagcggcaatagtaacgctaacagccgcgggccgagcttcagcagcggcctggtgccgttaagcttgcgcgagacgtcggaagagc

SEQ ID NO: 52754 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctacggcaatagtaacgctaacagccgcgggccgagcttcagcagcggcctggtgccgttaagcttgcgcgagacgtcggaagagc

SEQ ID NO: 52755 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctacaatagtaacgctaacagccgcgggccgagcttcagcagcggcctggtgccgttaagcttgcgcgagacgtcggaagagc

SEQ ID NO: 52756 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattacagtaacgctaacagccgcgggccgagcttcagcagcggcctggtgccgttaagcttgcgcgagacgtcggaagagc

SEQ ID NO: 52757 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttacaacgctaacagccgcgggccgagcttcagcagcggcctggtgccgttaagcttgcgcgagacgtcggaagagc

SEQ ID NO: 52758 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactacgctaacagccgcgggccgagcttcagcagcggcctggtgccgttaagcttgcgcgagacgtcggaagagc

SEQ ID NO: 52759 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttacaacagccgcgggccgagcttcagcagcggcctggtgccgttaagcttgcgcgagacgtcggaagagc

SEQ ID NO: 52760 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactacagccgcgggccgagcttcagcagcggcctggtgccgttaagcttgcgcgagacgtcggaagagc

SEQ ID NO: 52761 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctaccgcgggccgagcttcagcagcggcctggtgccgttaagcttgcgcgagacgtcggaagagc

SEQ ID NO: 52762 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctacgggccgagcttcagcagcggcctggtgccgttaagcttgcgcgagacgtcggaagagc

SEQ ID NO: 52763 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtacccgagcttcagcagcggcctggtgccgttaagcttgcgcgagacgtcggaagagc

SEQ ID NO: 52764 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtacagcttcagcagcggcctggtgccgttaagcttgcgcgagacgtcggaagagc

SEQ ID NO: 52765 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctacttcagcagcggcctggtgccgttaagcttgcgcgagacgtcggaagagc

SEQ ID NO: 52766 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctacagcagcggcctggtgccgttaagcttgcgcgagacgtcggaagagc

SEQ ID NO: 52767 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctacagcggcctggtgccgttaagcttgcgcgagacgtcggaagagc

SEQ ID NO: 52768 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctacggcctggtgccgttaagcttgcgcgagacgtcggaagagc

SEQ ID NO: 52769 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctacctggtgccgttaagcttgcgcgagacgtcggaagagc

SEQ ID NO: 52770 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtacgtgccgttaagcttgcgcgagacgtcggaagagc

SEQ ID NO: 52771 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtacccgttaagcttgcgcgagacgtcggaagagc

SEQ ID NO: 52772 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtacttaagcttgcgcgagacgtcggaagagc

SEQ ID NO: 52773 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatacagcttgcgcgagacgtcggaagagc

SEQ ID NO: 52774 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagctacttgcgcgagacgtcggaagagc

SEQ ID NO: 52775 - RNA, 296 nt, synthetic construct
  source 1..296: mol_type = other RNA
cgctcttccgcgtctcgtcttcatgttgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52776 - RNA, 296 nt, synthetic construct
  source 1..296: mol_type = other RNA
cgctcttccgcgtctcgtcttcatgaacttggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52777 - RNA, 296 nt, synthetic construct
  source 1..296: mol_type = other RNA
cgctcttccgcgtctcgtcttcatgaacgagttgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52778 - RNA, 296 nt, synthetic construct
  source 1..296: mol_type = other RNA
cgctcttccgcgtctcgtcttcatgaacgagaagttggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52779 - RNA, 296 nt, synthetic construct
  source 1..296: mol_type = other RNA
cgctcttccgcgtctcgtcttcatgaacgagaaggagttggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52780 - RNA, 296 nt, synthetic construct
  source 1..296: mol_type = other RNA
cgctcttccgcgtctcgtcttcatgaacgagaaggaggacttgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52781 - RNA, 296 nt, synthetic construct
  source 1..296: mol_type = other RNA
cgctcttccgcgtctcgtcttcatgaacgagaaggaggacatcttgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52782 - RNA, 296 nt, synthetic construct
  source 1..296: mol_type = other RNA
cgctcttccgcgtctcgtcttcatgaacgagaaggaggacatcctgttgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52783 - RNA, 296 nt, synthetic construct
  source 1..296: mol_type = other RNA
cgctcttccgcgtctcgtcttcatgaacgagaaggaggacatcctgtggttgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52784 - RNA, 296 nt, synthetic construct
  source 1..296: mol_type = other RNA
cgctcttccgcgtctcgtcttcatgaacgagaaggaggacatcctgtggtgcttgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52785 - RNA, 296 nt, synthetic construct
  source 1..296: mol_type = other RNA
cgctcttccgcgtctcgtcttcatgaacgagaaggaggacatcctgtggtgcactttggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52786 - RNA, 296 nt, synthetic construct
  source 1..296: mol_type = other RNA
cgctcttccgcgtctcgtcttcatgaacgagaaggaggacatcctgtggtgcactgaattgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52787 - RNA, 296 nt, synthetic construct
  source 1..296: mol_type = other RNA
cgctcttccgcgtctcgtcttcatgaacgagaaggaggacatcctgtggtgcactgaaatgttggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52788 - RNA, 296 nt, synthetic construct
  source 1..296: mol_type = other RNA
cgctcttccgcgtctcgtcttcatgaacgagaaggaggacatcctgtggtgcactgaaatggaattgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52789 - RNA, 296 nt, synthetic construct
  source 1..296: mol_type = other RNA
cgctcttccgcgtctcgtcttcatgaacgagaaggaggacatcctgtggtgcactgaaatggaaaggttggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52790 - RNA, 296 nt, synthetic construct
  source 1..296: mol_type = other RNA
cgctcttccgcgtctcgtcttcatgaacgagaaggaggacatcctgtggtgcactgaaatggaaagggtgttgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52791 - RNA, 296 nt, synthetic construct
  source 1..296: mol_type = other RNA
cgctcttccgcgtctcgtcttcatgaacgagaaggaggacatcctgtggtgcactgaaatggaaagggtgtttttgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52792 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52793 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcttgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52794 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccttggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52795 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcttgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52796 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacttgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52797 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacttgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52798 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacattggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52799 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacttggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52800 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgttgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52801 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccttgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52802 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacttgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52803 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgttgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52804 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcttgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52805 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52806 - RNA, 296 nt, synthetic construct; identical to SEQ ID NO: 52805
  source 1..296: mol_type = other RNA

SEQ ID NO: 52807 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgttgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52808 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggttgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52809 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagttgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52810 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagattgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52811 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgttgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52812 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgttgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52813 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcttgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52814 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggttgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52815 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgttgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52816 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggttgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52817 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcttggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52818 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgttgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52819 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgttggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52820 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcttgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52821 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcttgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52822 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcttgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52823 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacttgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52824 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52825 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcttggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52826 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctttgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52827 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgttgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52828 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgttgaaggaatattttgcttgtgtgtctagcggcaatagtaacgctaacagccgcgggccgagcttcagcagcggcctggtgccgttaagcttgcgcgagacgtcggaagagc

SEQ ID NO: 52829 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagttggaatattttgcttgtgtgtctagcggcaatagtaacgctaacagccgcgggccgagcttcagcagcggcctggtgccgttaagcttgcgcgagacgtcggaagagc

SEQ ID NO: 52830 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaattgtattttgcttgtgtgtctagcggcaatagtaacgctaacagccgcgggccgagcttcagcagcggcctggtgccgttaagcttgcgcgagacgtcggaagagc

SEQ ID NO: 52831 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttgtttgcttgtgtgtctagcggcaatagtaacgctaacagccgcgggccgagcttcagcagcggcctggtgccgttaagcttgcgcgagacgtcggaagagc

SEQ ID NO: 52832 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttttggcttgtgtgtctagcggcaatagtaacgctaacagccgcgggccgagcttcagcagcggcctggtgccgttaagcttgcgcgagacgtcggaagagc

SEQ ID NO: 52833 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctttgtgtgtgtctagcggcaatagtaacgctaacagccgcgggccgagcttcagcagcggcctggtgccgttaagcttgcgcgagacgtcggaagagc

SEQ ID NO: 52834 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtttggtgtctagcggcaatagtaacgctaacagccgcgggccgagcttcagcagcggcctggtgccgttaagcttgcgcgagacgtcggaagagc

SEQ ID NO: 52835 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgttgtctagcggcaatagtaacgctaacagccgcgggccgagcttcagcagcggcctggtgccgttaagcttgcgcgagacgtcggaagagc

SEQ ID NO: 52836 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctttgagcggcaatagtaacgctaacagccgcgggccgagcttcagcagcggcctggtgccgttaagcttgcgcgagacgtcggaagagc

SEQ ID NO: 52837 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcttgggcaatagtaacgctaacagccgcgggccgagcttcagcagcggcctggtgccgttaagcttgcgcgagacgtcggaagagc

SEQ ID NO: 52838 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcttgaatagtaacgctaacagccgcgggccgagcttcagcagcggcctggtgccgttaagcttgcgcgagacgtcggaagagc

SEQ ID NO: 52839 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatttgagtaacgctaacagccgcgggccgagcttcagcagcggcctggtgccgttaagcttgcgcgagacgtcggaagagc

SEQ ID NO: 52840 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtttgaacgctaacagccgcgggccgagcttcagcagcggcctggtgccgttaagcttgcgcgagacgtcggaagagc

SEQ ID NO: 52841 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacttggctaacagccgcgggccgagcttcagcagcggcctggtgccgttaagcttgcgcgagacgtcggaagagc

SEQ ID NO: 52842 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctttgaacagccgcgggccgagcttcagcagcggcctggtgccgttaagcttgcgcgagacgtcggaagagc

SEQ ID NO: 52843 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacttgagccgcgggccgagcttcagcagcggcctggtgccgttaagcttgcgcgagacgtcggaagagc

SEQ ID NO: 52844 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcttgcgcgggccgagcttcagcagcggcctggtgccgttaagcttgcgcgagacgtcggaagagc

SEQ ID NO: 52845 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcttggggccgagcttcagcagcggcctggtgccgttaagcttgcgcgagacgtcggaagagc

SEQ ID NO: 52846 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggttgccgagcttcagcagcggcctggtgccgttaagcttgcgcgagacgtcggaagagc

SEQ ID NO: 52847 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgttgagcttcagcagcggcctggtgccgttaagcttgcgcgagacgtcggaagagc

SEQ ID NO: 52848 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttgttcagcagcggcctggtgccgttaagcttgcgcgagacgtcggaagagc

SEQ ID NO: 52849 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcttgagcagcggcctggtgccgttaagcttgcgcgagacgtcggaagagc

SEQ ID NO: 52850 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcttgagcggcctggtgccgttaagcttgcgcgagacgtcggaagagc

SEQ ID NO: 52851 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcttgggcctggtgccgttaagcttgcgcgagacgtcggaagagc

SEQ ID NO: 52852 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcttgctggtgccgttaagcttgcgcgagacgtcggaagagc

SEQ ID NO: 52853 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgttggtgccgttaagcttgcgcgagacgtcggaagagc

SEQ ID NO: 52854 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgttgccgttaagcttgcgcgagacgtcggaagagc

SEQ ID NO: 52855 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttgttaagcttgcgcgagacgtcggaagagc

SEQ ID NO: 52856 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttattgagcttgcgcgagacgtcggaagagc

SEQ ID NO: 52857 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgttgcgcgagacgtcggaagagc

SEQ ID NO: 52858 - RNA, 296 nt, synthetic construct
  source 1..296: mol_type = other RNA
cgctcttccgcgtctcgtcttcatgttcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52859 - RNA, 296 nt, synthetic construct
  source 1..296: mol_type = other RNA
cgctcttccgcgtctcgtcttcatgaacttcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52860 - RNA, 296 nt, synthetic construct
  source 1..296: mol_type = other RNA
cgctcttccgcgtctcgtcttcatgaacgagttcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52861 - RNA, 296 nt, synthetic construct
  source 1..296: mol_type = other RNA
cgctcttccgcgtctcgtcttcatgaacgagaagttcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52862 - RNA, 296 nt, synthetic construct
  source 1..296: mol_type = other RNA
cgctcttccgcgtctcgtcttcatgaacgagaaggagttcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52863 - RNA, 296 nt, synthetic construct
  source 1..296: mol_type = other RNA
cgctcttccgcgtctcgtcttcatgaacgagaaggaggacttcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52864 - RNA, 296 nt, synthetic construct
  source 1..296: mol_type = other RNA
cgctcttccgcgtctcgtcttcatgaacgagaaggaggacatcttcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52865 - RNA, 296 nt, synthetic construct
  source 1..296: mol_type = other RNA
cgctcttccgcgtctcgtcttcatgaacgagaaggaggacatcctgttctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52866 - RNA, 296 nt, synthetic construct
  source 1..296: mol_type = other RNA
cgctcttccgcgtctcgtcttcatgaacgagaaggaggacatcctgtggttctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52867 - RNA, 296 nt, synthetic construct
  source 1..296: mol_type = other RNA
cgctcttccgcgtctcgtcttcatgaacgagaaggaggacatcctgtggtgcttcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52868 - RNA, 296 nt, synthetic construct
  source 1..296: mol_type = other RNA
cgctcttccgcgtctcgtcttcatgaacgagaaggaggacatcctgtggtgcactttcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52869 - RNA, 296 nt, synthetic construct
  source 1..296: mol_type = other RNA
cgctcttccgcgtctcgtcttcatgaacgagaaggaggacatcctgtggtgcactgaattcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52870 - RNA, 296 nt, synthetic construct
  source 1..296: mol_type = other RNA
cgctcttccgcgtctcgtcttcatgaacgagaaggaggacatcctgtggtgcactgaaatgttcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52871 - RNA, 296 nt, synthetic construct
  source 1..296: mol_type = other RNA
cgctcttccgcgtctcgtcttcatgaacgagaaggaggacatcctgtggtgcactgaaatggaattcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52872 - RNA, 296 nt, synthetic construct
  source 1..296: mol_type = other RNA
cgctcttccgcgtctcgtcttcatgaacgagaaggaggacatcctgtggtgcactgaaatggaaaggttcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52873 - RNA, 296 nt, synthetic construct
  source 1..296: mol_type = other RNA
cgctcttccgcgtctcgtcttcatgaacgagaaggaggacatcctgtggtgcactgaaatggaaagggtgttctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52874 - RNA, 296 nt, synthetic construct
  source 1..296: mol_type = other RNA
cgctcttccgcgtctcgtcttcatgaacgagaaggaggacatcctgtggtgcactgaaatggaaagggtgtttttcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52875 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52876 - RNA, 296 nt, synthetic construct; identical to SEQ ID NO: 52875
  source 1..296: mol_type = other RNA

SEQ ID NO: 52877 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccttcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52878 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcttccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52879 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacttctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52880 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacttcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52881 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacattcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52882 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacttcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52883 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgttctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52884 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccttcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52885 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacttcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52886 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgttcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52887 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcttccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52888 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52889 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgttcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52890 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgttcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52891 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggttccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52892 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagttcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52893 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagattcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52894 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgttcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52895 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgttcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52896 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcttccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52897 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggttctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52898 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgttctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52899 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggttcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52900 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcttcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52901 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgttcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52902 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgttcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52903 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcttcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52904 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcttccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52905 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcttccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52906 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacttcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52907 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52908 - RNA, 296 nt, synthetic construct; identical to SEQ ID NO: 52907
  source 1..296: mol_type = other RNA

SEQ ID NO: 52909 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctttcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52910 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgttcctgaaggaatattttgcttgtgtgtctagcggcaatagtaacgctaacagccgcgggccgagcttcagcagcggcctggtgccgttaagcttgcgcgagacgtcggaagagc

SEQ ID NO: 52911 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgttcaaggaatattttgcttgtgtgtctagcggcaatagtaacgctaacagccgcgggccgagcttcagcagcggcctggtgccgttaagcttgcgcgagacgtcggaagagc

SEQ ID NO: 52912 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagttcgaatattttgcttgtgtgtctagcggcaatagtaacgctaacagccgcgggccgagcttcagcagcggcctggtgccgttaagcttgcgcgagacgtcggaagagc

SEQ ID NO: 52913 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaattctattttgcttgtgtgtctagcggcaatagtaacgctaacagccgcgggccgagcttcagcagcggcctggtgccgttaagcttgcgcgagacgtcggaagagc

SEQ ID NO: 52914 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttctttgcttgtgtgtctagcggcaatagtaacgctaacagccgcgggccgagcttcagcagcggcctggtgccgttaagcttgcgcgagacgtcggaagagc

SEQ ID NO: 52915 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttttcgcttgtgtgtctagcggcaatagtaacgctaacagccgcgggccgagcttcagcagcggcctggtgccgttaagcttgcgcgagacgtcggaagagc

SEQ ID NO: 52916 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctttctgtgtgtctagcggcaatagtaacgctaacagccgcgggccgagcttcagcagcggcctggtgccgttaagcttgcgcgagacgtcggaagagc

SEQ ID NO: 52917 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtttcgtgtctagcggcaatagtaacgctaacagccgcgggccgagcttcagcagcggcctggtgccgttaagcttgcgcgagacgtcggaagagc

SEQ ID NO: 52918 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgttctctagcggcaatagtaacgctaacagccgcgggccgagcttcagcagcggcctggtgccgttaagcttgcgcgagacgtcggaagagc

SEQ ID NO: 52919 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctttcagcggcaatagtaacgctaacagccgcgggccgagcttcagcagcggcctggtgccgttaagcttgcgcgagacgtcggaagagc

SEQ ID NO: 52920 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcttcggcaatagtaacgctaacagccgcgggccgagcttcagcagcggcctggtgccgttaagcttgcgcgagacgtcggaagagc

SEQ ID NO: 52921 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcttcaatagtaacgctaacagccgcgggccgagcttcagcagcggcctggtgccgttaagcttgcgcgagacgtcggaagagc

SEQ ID NO: 52922 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatttcagtaacgctaacagccgcgggccgagcttcagcagcggcctggtgccgttaagcttgcgcgagacgtcggaagagc

SEQ ID NO: 52923 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtttcaacgctaacagccgcgggccgagcttcagcagcggcctggtgccgttaagcttgcgcgagacgtcggaagagc

SEQ ID NO: 52924 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacttcgctaacagccgcgggccgagcttcagcagcggcctggtgccgttaagcttgcgcgagacgtcggaagagc

SEQ ID NO: 52925 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctttcaacagccgcgggccgagcttcagcagcggcctggtgccgttaagcttgcgcgagacgtcggaagagc

SEQ ID NO: 52926 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacttcagccgcgggccgagcttcagcagcggcctggtgccgttaagcttgcgcgagacgtcggaagagc

SEQ ID NO: 52927 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcttccgcgggccgagcttcagcagcggcctggtgccgttaagcttgcgcgagacgtcggaagagc

SEQ ID NO: 52928 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcttcgggccgagcttcagcagcggcctggtgccgttaagcttgcgcgagacgtcggaagagc

SEQ ID NO: 52929 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggttcccgagcttcagcagcggcctggtgccgttaagcttgcgcgagacgtcggaagagc

SEQ ID NO: 52930 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgttcagcttcagcagcggcctggtgccgttaagcttgcgcgagacgtcggaagagc

SEQ ID NO: 52931 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcttcagcagcggcctggtgccgttaagcttgcgcgagacgtcggaagagc

SEQ ID NO: 52932 - RNA, 296 nt, synthetic construct; identical to SEQ ID NO: 52931
  source 1..296: mol_type = other RNA

SEQ ID NO: 52933 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcttcagcggcctggtgccgttaagcttgcgcgagacgtcggaagagc

SEQ ID NO: 52934 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcttcggcctggtgccgttaagcttgcgcgagacgtcggaagagc

SEQ ID NO: 52935 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcttcctggtgccgttaagcttgcgcgagacgtcggaagagc

SEQ ID NO: 52936 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgttcgtgccgttaagcttgcgcgagacgtcggaagagc

SEQ ID NO: 52937 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgttcccgttaagcttgcgcgagacgtcggaagagc

SEQ ID NO: 52938 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttcttaagcttgcgcgagacgtcggaagagc

SEQ ID NO: 52939 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttattcagcttgcgcgagacgtcggaagagc

SEQ ID NO: 52940 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttcttgcgcgagacgtcggaagagc

SEQ ID NO: 52941 - RNA, 296 nt, synthetic construct
  source 1..296: mol_type = other RNA
cgctcttccgcgtctcgtcttcatgtggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52942 - RNA, 296 nt, synthetic construct
  source 1..296: mol_type = other RNA
cgctcttccgcgtctcgtcttcatgaactgggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52943 - RNA, 296 nt, synthetic construct
  source 1..296: mol_type = other RNA
cgctcttccgcgtctcgtcttcatgaacgagtggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52944 - RNA, 296 nt, synthetic construct
  source 1..296: mol_type = other RNA
cgctcttccgcgtctcgtcttcatgaacgagaagtgggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52945 - RNA, 296 nt, synthetic construct
  source 1..296: mol_type = other RNA
cgctcttccgcgtctcgtcttcatgaacgagaaggagtgggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52946 - RNA, 296 nt, synthetic construct
  source 1..296: mol_type = other RNA
cgctcttccgcgtctcgtcttcatgaacgagaaggaggactggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52947 - RNA, 296 nt, synthetic construct
  source 1..296: mol_type = other RNA
cgctcttccgcgtctcgtcttcatgaacgagaaggaggacatctggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52948 - RNA, 296 nt, synthetic construct
  source 1..296: mol_type = other RNA
cgctcttccgcgtctcgtcttcatgaacgagaaggaggacatcctgtggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52949 - RNA, 296 nt, synthetic construct; identical to SEQ ID NO: 52948
  source 1..296: mol_type = other RNA

SEQ ID NO: 52950 - RNA, 296 nt, synthetic construct
  source 1..296: mol_type = other RNA
cgctcttccgcgtctcgtcttcatgaacgagaaggaggacatcctgtggtgctggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52951 - RNA, 296 nt, synthetic construct
  source 1..296: mol_type = other RNA
cgctcttccgcgtctcgtcttcatgaacgagaaggaggacatcctgtggtgcacttgggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52952 - RNA, 296 nt, synthetic construct
  source 1..296: mol_type = other RNA
cgctcttccgcgtctcgtcttcatgaacgagaaggaggacatcctgtggtgcactgaatggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52953 - RNA, 296 nt, synthetic construct
  source 1..296: mol_type = other RNA
cgctcttccgcgtctcgtcttcatgaacgagaaggaggacatcctgtggtgcactgaaatgtgggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52954 - RNA, 296 nt, synthetic construct
  source 1..296: mol_type = other RNA
cgctcttccgcgtctcgtcttcatgaacgagaaggaggacatcctgtggtgcactgaaatggaatggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52955 - RNA, 296 nt, synthetic construct
  source 1..296: mol_type = other RNA
cgctcttccgcgtctcgtcttcatgaacgagaaggaggacatcctgtggtgcactgaaatggaaaggtgggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52956 - RNA, 296 nt, synthetic construct
  source 1..296: mol_type = other RNA
cgctcttccgcgtctcgtcttcatgaacgagaaggaggacatcctgtggtgcactgaaatggaaagggtgtggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52957 - RNA, 296 nt, synthetic construct
  source 1..296: mol_type = other RNA
cgctcttccgcgtctcgtcttcatgaacgagaaggaggacatcctgtggtgcactgaaatggaaagggtgttttggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52958 - RNA, 296 nt, synthetic construct
  source 1..296: mol_type = other RNA
cgctcttccgcgtctcgtcttcatgaacgagaaggaggacatcctgtggtgcactgaaatggaaagggtgtttggctggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52959 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttctggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52960 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccctgggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52961 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtctggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52962 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52963 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactactggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52964 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacatgggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52965 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagactgggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52966 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52967 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcctggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52968 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaactggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52969 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgtggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52970 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagctggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52971 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgctggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52972 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtgggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52973 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52974 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52975 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52976 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52977 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52978 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52979 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52980 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52981 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52982 - RNA, 296 nt, synthetic construct; identical to SEQ ID NO: 52981
  source 1..296: mol_type = other RNA

SEQ ID NO: 52983 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctgggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52984 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52985 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtgggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52986 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52987 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52988 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52989 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52990 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52991 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctgggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52992 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 52993 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtggctgaaggaatattttgcttgtgtgtctagcggcaatagtaacgctaacagccgcgggccgagcttcagcagcggcctggtgccgttaagcttgcgcgagacgtcggaagagc

SEQ ID NO: 52994 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtggaaggaatattttgcttgtgtgtctagcggcaatagtaacgctaacagccgcgggccgagcttcagcagcggcctggtgccgttaagcttgcgcgagacgtcggaagagc

SEQ ID NO: 52995 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtgggaatattttgcttgtgtgtctagcggcaatagtaacgctaacagccgcgggccgagcttcagcagcggcctggtgccgttaagcttgcgcgagacgtcggaagagc

SEQ ID NO: 52996 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatggtattttgcttgtgtgtctagcggcaatagtaacgctaacagccgcgggccgagcttcagcagcggcctggtgccgttaagcttgcgcgagacgtcggaagagc

SEQ ID NO: 52997 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattggtttgcttgtgtgtctagcggcaatagtaacgctaacagccgcgggccgagcttcagcagcggcctggtgccgttaagcttgcgcgagacgtcggaagagc

SEQ ID NO: 52998 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttgggcttgtgtgtctagcggcaatagtaacgctaacagccgcgggccgagcttcagcagcggcctggtgccgttaagcttgcgcgagacgtcggaagagc

SEQ ID NO: 52999 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttggtgtgtgtctagcggcaatagtaacgctaacagccgcgggccgagcttcagcagcggcctggtgccgttaagcttgcgcgagacgtcggaagagc

SEQ ID NO: 53000 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttgggtgtctagcggcaatagtaacgctaacagccgcgggccgagcttcagcagcggcctggtgccgttaagcttgcgcgagacgtcggaagagc

SEQ ID NO: 53001 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtggtctagcggcaatagtaacgctaacagccgcgggccgagcttcagcagcggcctggtgccgttaagcttgcgcgagacgtcggaagagc

SEQ ID NO: 53002 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttggagcggcaatagtaacgctaacagccgcgggccgagcttcagcagcggcctggtgccgttaagcttgcgcgagacgtcggaagagc

SEQ ID NO: 53003 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctggggcaatagtaacgctaacagccgcgggccgagcttcagcagcggcctggtgccgttaagcttgcgcgagacgtcggaagagc

SEQ ID NO: 53004 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctggaatagtaacgctaacagccgcgggccgagcttcagcagcggcctggtgccgttaagcttgcgcgagacgtcggaagagc

SEQ ID NO: 53005 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattggagtaacgctaacagccgcgggccgagcttcagcagcggcctggtgccgttaagcttgcgcgagacgtcggaagagc

SEQ ID NO: 53006 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttggaacgctaacagccgcgggccgagcttcagcagcggcctggtgccgttaagcttgcgcgagacgtcggaagagc

SEQ ID NO: 53007 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactgggctaacagccgcgggccgagcttcagcagcggcctggtgccgttaagcttgcgcgagacgtcggaagagc

SEQ ID NO: 53008 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttggaacagccgcgggccgagcttcagcagcggcctggtgccgttaagcttgcgcgagacgtcggaagagc

SEQ ID NO: 53009 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactggagccgcgggccgagcttcagcagcggcctggtgccgttaagcttgcgcgagacgtcggaagagc

SEQ ID NO: 53010 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctggcgcgggccgagcttcagcagcggcctggtgccgttaagcttgcgcgagacgtcggaagagc

SEQ ID NO: 53011 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctgggggccgagcttcagcagcggcctggtgccgttaagcttgcgcgagacgtcggaagagc

SEQ ID NO: 53012 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtggccgagcttcagcagcggcctggtgccgttaagcttgcgcgagacgtcggaagagc

SEQ ID NO: 53013 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtggagcttcagcagcggcctggtgccgttaagcttgcgcgagacgtcggaagagc

SEQ ID NO: 53014 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctggttcagcagcggcctggtgccgttaagcttgcgcgagacgtcggaagagc

SEQ ID NO: 53015 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctggagcagcggcctggtgccgttaagcttgcgcgagacgtcggaagagc

SEQ ID NO: 53016 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctggagcggcctggtgccgttaagcttgcgcgagacgtcggaagagc

SEQ ID NO: 53017 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctggggcctggtgccgttaagcttgcgcgagacgtcggaagagc

SEQ ID NO: 53018 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctggctggtgccgttaagcttgcgcgagacgtcggaagagc

SEQ ID NO: 53019 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtgggtgccgttaagcttgcgcgagacgtcggaagagc

SEQ ID NO: 53020 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtggccgttaagcttgcgcgagacgtcggaagagc

SEQ ID NO: 53021 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtggttaagcttgcgcgagacgtcggaagagc

SEQ ID NO: 53022 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatggagcttgcgcgagacgtcggaagagc

SEQ ID NO: 53023 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagctggttgcgcgagacgtcggaagagc

SEQ ID NO: 53024 - RNA, 296 nt, synthetic construct
  source 1..296: mol_type = other RNA
cgctcttccgcgtctcgtcttcatgtgcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53025 - RNA, 296 nt, synthetic construct
  source 1..296: mol_type = other RNA
cgctcttccgcgtctcgtcttcatgaactgcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53026 - RNA, 296 nt, synthetic construct
  source 1..296: mol_type = other RNA
cgctcttccgcgtctcgtcttcatgaacgagtgcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53027 - RNA, 296 nt, synthetic construct
  source 1..296: mol_type = other RNA
cgctcttccgcgtctcgtcttcatgaacgagaagtgcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53028 - RNA, 296 nt, synthetic construct
  source 1..296: mol_type = other RNA
cgctcttccgcgtctcgtcttcatgaacgagaaggagtgcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53029 - RNA, 296 nt, synthetic construct
  source 1..296: mol_type = other RNA
cgctcttccgcgtctcgtcttcatgaacgagaaggaggactgcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53030 - RNA, 296 nt, synthetic construct
  source 1..296: mol_type = other RNA
cgctcttccgcgtctcgtcttcatgaacgagaaggaggacatctgcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53031 - RNA, 296 nt, synthetic construct
  source 1..296: mol_type = other RNA
cgctcttccgcgtctcgtcttcatgaacgagaaggaggacatcctgtgctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53032 - RNA, 296 nt, synthetic construct
  source 1..296: mol_type = other RNA
cgctcttccgcgtctcgtcttcatgaacgagaaggaggacatcctgtggtgctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53033 - RNA, 296 nt, synthetic construct; identical to SEQ ID NO: 53032
  source 1..296: mol_type = other RNA

SEQ ID NO: 53034 - RNA, 296 nt, synthetic construct
  source 1..296: mol_type = other RNA
cgctcttccgcgtctcgtcttcatgaacgagaaggaggacatcctgtggtgcacttgcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53035 - RNA, 296 nt, synthetic construct
  source 1..296: mol_type = other RNA
cgctcttccgcgtctcgtcttcatgaacgagaaggaggacatcctgtggtgcactgaatgcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53036 - RNA, 296 nt, synthetic construct
  source 1..296: mol_type = other RNA
cgctcttccgcgtctcgtcttcatgaacgagaaggaggacatcctgtggtgcactgaaatgtgcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53037 - RNA, 296 nt, synthetic construct
  source 1..296: mol_type = other RNA
cgctcttccgcgtctcgtcttcatgaacgagaaggaggacatcctgtggtgcactgaaatggaatgcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53038 - RNA, 296 nt, synthetic construct
  source 1..296: mol_type = other RNA
cgctcttccgcgtctcgtcttcatgaacgagaaggaggacatcctgtggtgcactgaaatggaaaggtgcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53039 - RNA, 296 nt, synthetic construct
  source 1..296: mol_type = other RNA
cgctcttccgcgtctcgtcttcatgaacgagaaggaggacatcctgtggtgcactgaaatggaaagggtgtgctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53040 - RNA, 296 nt, synthetic construct
  source 1..296: mol_type = other RNA
cgctcttccgcgtctcgtcttcatgaacgagaaggaggacatcctgtggtgcactgaaatggaaagggtgttttgcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53041 - RNA, 296 nt, synthetic construct
  source 1..296: mol_type = other RNA
cgctcttccgcgtctcgtcttcatgaacgagaaggaggacatcctgtggtgcactgaaatggaaagggtgtttggctgcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53042 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttctgccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53043 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccctgcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53044 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtctgccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53045 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactgctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53046 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactactgcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53047 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacatgcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53048 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagactgcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53049 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtgctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53050 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcctgcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53051 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaactgcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53052 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgtgcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53053 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagctgccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53054 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgctgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53055 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtgcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53056 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtgcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53057 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtgccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53058 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtgcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53059 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatgcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53060 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtgcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53061 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtgcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53062 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctgccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53063 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtgctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53064 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53065 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtgcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53066 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctgcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53067 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtgcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53068 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtgcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53069 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctgcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53070 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctgccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53071 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53072 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactgcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53073 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctgcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53074 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctgcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53075 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttgcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53076 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtgcctgaaggaatattttgcttgtgtgtctagcggcaatagtaacgctaacagccgcgggccgagcttcagcagcggcctggtgccgttaagcttgcgcgagacgtcggaagagc

SEQ ID NO: 53077 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtgcaaggaatattttgcttgtgtgtctagcggcaatagtaacgctaacagccgcgggccgagcttcagcagcggcctggtgccgttaagcttgcgcgagacgtcggaagagc

SEQ ID NO: 53078 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtgcgaatattttgcttgtgtgtctagcggcaatagtaacgctaacagccgcgggccgagcttcagcagcggcctggtgccgttaagcttgcgcgagacgtcggaagagc

SEQ ID NO: 53079 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatgctattttgcttgtgtgtctagcggcaatagtaacgctaacagccgcgggccgagcttcagcagcggcctggtgccgttaagcttgcgcgagacgtcggaagagc

SEQ ID NO: 53080 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattgctttgcttgtgtgtctagcggcaatagtaacgctaacagccgcgggccgagcttcagcagcggcctggtgccgttaagcttgcgcgagacgtcggaagagc

SEQ ID NO: 53081 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttgcgcttgtgtgtctagcggcaatagtaacgctaacagccgcgggccgagcttcagcagcggcctggtgccgttaagcttgcgcgagacgtcggaagagc

SEQ ID NO: 53082 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgctgtgtgtctagcggcaatagtaacgctaacagccgcgggccgagcttcagcagcggcctggtgccgttaagcttgcgcgagacgtcggaagagc

SEQ ID NO: 53083 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttgcgtgtctagcggcaatagtaacgctaacagccgcgggccgagcttcagcagcggcctggtgccgttaagcttgcgcgagacgtcggaagagc

SEQ ID NO: 53084 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtgctctagcggcaatagtaacgctaacagccgcgggccgagcttcagcagcggcctggtgccgttaagcttgcgcgagacgtcggaagagc

SEQ ID NO: 53085 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttgcagcggcaatagtaacgctaacagccgcgggccgagcttcagcagcggcctggtgccgttaagcttgcgcgagacgtcggaagagc

SEQ ID NO: 53086 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctgcggcaatagtaacgctaacagccgcgggccgagcttcagcagcggcctggtgccgttaagcttgcgcgagacgtcggaagagc

SEQ ID NO: 53087 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctgcaatagtaacgctaacagccgcgggccgagcttcagcagcggcctggtgccgttaagcttgcgcgagacgtcggaagagc

SEQ ID NO: 53088 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattgcagtaacgctaacagccgcgggccgagcttcagcagcggcctggtgccgttaagcttgcgcgagacgtcggaagagc

SEQ ID NO: 53089 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttgcaacgctaacagccgcgggccgagcttcagcagcggcctggtgccgttaagcttgcgcgagacgtcggaagagc

SEQ ID NO: 53090 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactgcgctaacagccgcgggccgagcttcagcagcggcctggtgccgttaagcttgcgcgagacgtcggaagagc

SEQ ID NO: 53091 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttgcaacagccgcgggccgagcttcagcagcggcctggtgccgttaagcttgcgcgagacgtcggaagagc

SEQ ID NO: 53092 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactgcagccgcgggccgagcttcagcagcggcctggtgccgttaagcttgcgcgagacgtcggaagagc

SEQ ID NO: 53093 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctgccgcgggccgagcttcagcagcggcctggtgccgttaagcttgcgcgagacgtcggaagagc

SEQ ID NO: 53094 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctgcgggccgagcttcagcagcggcctggtgccgttaagcttgcgcgagacgtcggaagagc

SEQ ID NO: 53095 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtgcccgagcttcagcagcggcctggtgccgttaagcttgcgcgagacgtcggaagagc

SEQ ID NO: 53096 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtgcagcttcagcagcggcctggtgccgttaagcttgcgcgagacgtcggaagagc

SEQ ID NO: 53097 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctgcttcagcagcggcctggtgccgttaagcttgcgcgagacgtcggaagagc

SEQ ID NO: 53098 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctgcagcagcggcctggtgccgttaagcttgcgcgagacgtcggaagagc

SEQ ID NO: 53099 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctgcagcggcctggtgccgttaagcttgcgcgagacgtcggaagagc

SEQ ID NO: 53100 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctgcggcctggtgccgttaagcttgcgcgagacgtcggaagagc

SEQ ID NO: 53101 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctgcctggtgccgttaagcttgcgcgagacgtcggaagagc

SEQ ID NO: 53102 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtgcgtgccgttaagcttgcgcgagacgtcggaagagc

SEQ ID NO: 53103 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtgcccgttaagcttgcgcgagacgtcggaagagc

SEQ ID NO: 53104 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtgcttaagcttgcgcgagacgtcggaagagc

SEQ ID NO: 53105 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatgcagcttgcgcgagacgtcggaagagc

SEQ ID NO: 53106 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagctgcttgcgcgagacgtcggaagagc

SEQ ID NO: 53107 - RNA, 296 nt, synthetic construct
  source 1..296: mol_type = other RNA
cgctcttccgcgtctcgtcttcatgtcgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53108 - RNA, 296 nt, synthetic construct
  source 1..296: mol_type = other RNA
cgctcttccgcgtctcgtcttcatgaactcggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53109 - RNA, 296 nt, synthetic construct
  source 1..296: mol_type = other RNA
cgctcttccgcgtctcgtcttcatgaacgagtcgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53110 - RNA, 296 nt, synthetic construct
  source 1..296: mol_type = other RNA
cgctcttccgcgtctcgtcttcatgaacgagaagtcggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53111 - RNA, 296 nt, synthetic construct
  source 1..296: mol_type = other RNA
cgctcttccgcgtctcgtcttcatgaacgagaaggagtcggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53112 - RNA, 296 nt, synthetic construct
  source 1..296: mol_type = other RNA
cgctcttccgcgtctcgtcttcatgaacgagaaggaggactcgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53113 - RNA, 296 nt, synthetic construct
  source 1..296: mol_type = other RNA
cgctcttccgcgtctcgtcttcatgaacgagaaggaggacatctcgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53114 - RNA, 296 nt, synthetic construct
  source 1..296: mol_type = other RNA
cgctcttccgcgtctcgtcttcatgaacgagaaggaggacatcctgtcgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53115 - RNA, 296 nt, synthetic construct
  source 1..296: mol_type = other RNA
cgctcttccgcgtctcgtcttcatgaacgagaaggaggacatcctgtggtcgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53116 - RNA, 296 nt, synthetic construct
  source 1..296: mol_type = other RNA
cgctcttccgcgtctcgtcttcatgaacgagaaggaggacatcctgtggtgctcgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53117 - RNA, 296 nt, synthetic construct
  source 1..296: mol_type = other RNA
cgctcttccgcgtctcgtcttcatgaacgagaaggaggacatcctgtggtgcacttcggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53118 - RNA, 296 nt, synthetic construct
  source 1..296: mol_type = other RNA
cgctcttccgcgtctcgtcttcatgaacgagaaggaggacatcctgtggtgcactgaatcgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53119 - RNA, 296 nt, synthetic construct
  source 1..296: mol_type = other RNA
cgctcttccgcgtctcgtcttcatgaacgagaaggaggacatcctgtggtgcactgaaatgtcggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53120 - RNA, 296 nt, synthetic construct
  source 1..296: mol_type = other RNA
cgctcttccgcgtctcgtcttcatgaacgagaaggaggacatcctgtggtgcactgaaatggaatcgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53121 - RNA, 296 nt, synthetic construct
  source 1..296: mol_type = other RNA
cgctcttccgcgtctcgtcttcatgaacgagaaggaggacatcctgtggtgcactgaaatggaaaggtcggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53122 - RNA, 296 nt, synthetic construct
  source 1..296: mol_type = other RNA
cgctcttccgcgtctcgtcttcatgaacgagaaggaggacatcctgtggtgcactgaaatggaaagggtgtcgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53123 - RNA, 296 nt, synthetic construct
  source 1..296: mol_type = other RNA
cgctcttccgcgtctcgtcttcatgaacgagaaggaggacatcctgtggtgcactgaaatggaaagggtgttttcgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53124 - RNA, 296 nt, synthetic construct
  source 1..296: mol_type = other RNA
cgctcttccgcgtctcgtcttcatgaacgagaaggaggacatcctgtggtgcactgaaatggaaagggtgtttggctcgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53125 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttctcgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53126 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccctcggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53127 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtctcgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53128 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactcgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53129 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactactcgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53130 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacatcggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53131 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagactcggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53132 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53133 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcctcgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53134 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaactcgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53135 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgtcgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53136 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagctcgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53137 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgctcgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53138 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtcggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53139 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53140 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtcgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53141 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtcgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53142 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatcgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53143 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtcgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53144 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtcgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53145 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctcgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53146 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53147 - RNA, 296 nt, synthetic construct; identical to SEQ ID NO: 53146
  source 1..296: mol_type = other RNA

SEQ ID NO: 53148 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtcgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53149 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctcggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53150 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtcgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53151 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtcggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53152 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctcgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53153 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctcgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53154 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctcgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53155 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactcgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53156 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctcgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53157 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctcggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53158 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttcgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53159 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtcgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53160 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtcgaaggaatattttgcttgtgtgtctagcggcaatagtaacgctaacagccgcgggccgagcttcagcagcggcctggtgccgttaagcttgcgcgagacgtcggaagagc

SEQ ID NO: 53161 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtcggaatattttgcttgtgtgtctagcggcaatagtaacgctaacagccgcgggccgagcttcagcagcggcctggtgccgttaagcttgcgcgagacgtcggaagagc

SEQ ID NO: 53162 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatcgtattttgcttgtgtgtctagcggcaatagtaacgctaacagccgcgggccgagcttcagcagcggcctggtgccgttaagcttgcgcgagacgtcggaagagc

SEQ ID NO: 53163 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattcgtttgcttgtgtgtctagcggcaatagtaacgctaacagccgcgggccgagcttcagcagcggcctggtgccgttaagcttgcgcgagacgtcggaagagc

SEQ ID NO: 53164 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttcggcttgtgtgtctagcggcaatagtaacgctaacagccgcgggccgagcttcagcagcggcctggtgccgttaagcttgcgcgagacgtcggaagagc

SEQ ID NO: 53165 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttcgtgtgtgtctagcggcaatagtaacgctaacagccgcgggccgagcttcagcagcggcctggtgccgttaagcttgcgcgagacgtcggaagagc

SEQ ID NO: 53166 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttcggtgtctagcggcaatagtaacgctaacagccgcgggccgagcttcagcagcggcctggtgccgttaagcttgcgcgagacgtcggaagagc

SEQ ID NO: 53167 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcgtctagcggcaatagtaacgctaacagccgcgggccgagcttcagcagcggcctggtgccgttaagcttgcgcgagacgtcggaagagc

SEQ ID NO: 53168 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttcgagcggcaatagtaacgctaacagccgcgggccgagcttcagcagcggcctggtgccgttaagcttgcgcgagacgtcggaagagc

SEQ ID NO: 53169 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctcgggcaatagtaacgctaacagccgcgggccgagcttcagcagcggcctggtgccgttaagcttgcgcgagacgtcggaagagc

SEQ ID NO: 53170 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctcgaatagtaacgctaacagccgcgggccgagcttcagcagcggcctggtgccgttaagcttgcgcgagacgtcggaagagc

SEQ ID NO: 53171 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattcgagtaacgctaacagccgcgggccgagcttcagcagcggcctggtgccgttaagcttgcgcgagacgtcggaagagc

SEQ ID NO: 53172 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttcgaacgctaacagccgcgggccgagcttcagcagcggcctggtgccgttaagcttgcgcgagacgtcggaagagc

SEQ ID NO: 53173 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactcggctaacagccgcgggccgagcttcagcagcggcctggtgccgttaagcttgcgcgagacgtcggaagagc

SEQ ID NO: 53174 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttcgaacagccgcgggccgagcttcagcagcggcctggtgccgttaagcttgcgcgagacgtcggaagagc

SEQ ID NO: 53175 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactcgagccgcgggccgagcttcagcagcggcctggtgccgttaagcttgcgcgagacgtcggaagagc

SEQ ID NO: 53176 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctcgcgcgggccgagcttcagcagcggcctggtgccgttaagcttgcgcgagacgtcggaagagc

SEQ ID NO: 53177 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctcggggccgagcttcagcagcggcctggtgccgttaagcttgcgcgagacgtcggaagagc

SEQ ID NO: 53178 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtcgccgagcttcagcagcggcctggtgccgttaagcttgcgcgagacgtcggaagagc

SEQ ID NO: 53179 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtcgagcttcagcagcggcctggtgccgttaagcttgcgcgagacgtcggaagagc

SEQ ID NO: 53180 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctcgttcagcagcggcctggtgccgttaagcttgcgcgagacgtcggaagagc

SEQ ID NO: 53181 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctcgagcagcggcctggtgccgttaagcttgcgcgagacgtcggaagagc

SEQ ID NO: 53182 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctcgagcggcctggtgccgttaagcttgcgcgagacgtcggaagagc

SEQ ID NO: 53183 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctcgggcctggtgccgttaagcttgcgcgagacgtcggaagagc

SEQ ID NO: 53184 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctcgctggtgccgttaagcttgcgcgagacgtcggaagagc

SEQ ID NO: 53185 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtcggtgccgttaagcttgcgcgagacgtcggaagagc

SEQ ID NO: 53186 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtcgccgttaagcttgcgcgagacgtcggaagagc

SEQ ID NO: 53187 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtcgttaagcttgcgcgagacgtcggaagagc

SEQ ID NO: 53188 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatcgagcttgcgcgagacgtcggaagagc

SEQ ID NO: 53189 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagctcgttgcgcgagacgtcggaagagc

SEQ ID NO: 53190 - RNA, 296 nt, synthetic construct
  source 1..296: mol_type = other RNA
cgctcttccgcgtctcgtcttcatgtccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53191 - RNA, 296 nt, synthetic construct
  source 1..296: mol_type = other RNA
cgctcttccgcgtctcgtcttcatgaactccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53192 - RNA, 296 nt, synthetic construct
  source 1..296: mol_type = other RNA
cgctcttccgcgtctcgtcttcatgaacgagtccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53193 - RNA, 296 nt, synthetic construct
  source 1..296: mol_type = other RNA
cgctcttccgcgtctcgtcttcatgaacgagaagtccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53194 - RNA, 296 nt, synthetic construct
  source 1..296: mol_type = other RNA
cgctcttccgcgtctcgtcttcatgaacgagaaggagtccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53195 - RNA, 296 nt, synthetic construct
  source 1..296: mol_type = other RNA
cgctcttccgcgtctcgtcttcatgaacgagaaggaggactccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53196 - RNA, 296 nt, synthetic construct
  source 1..296: mol_type = other RNA
cgctcttccgcgtctcgtcttcatgaacgagaaggaggacatctccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53197 - RNA, 296 nt, synthetic construct
  source 1..296: mol_type = other RNA
cgctcttccgcgtctcgtcttcatgaacgagaaggaggacatcctgtcctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53198 - RNA, 296 nt, synthetic construct
  source 1..296: mol_type = other RNA
cgctcttccgcgtctcgtcttcatgaacgagaaggaggacatcctgtggtcctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53199 - RNA, 296 nt, synthetic construct
  source 1..296: mol_type = other RNA
cgctcttccgcgtctcgtcttcatgaacgagaaggaggacatcctgtggtgctccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53200 - RNA, 296 nt, synthetic construct
  source 1..296: mol_type = other RNA
cgctcttccgcgtctcgtcttcatgaacgagaaggaggacatcctgtggtgcacttccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53201 - RNA, 296 nt, synthetic construct
  source 1..296: mol_type = other RNA
cgctcttccgcgtctcgtcttcatgaacgagaaggaggacatcctgtggtgcactgaatccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53202 - RNA, 296 nt, synthetic construct
  source 1..296: mol_type = other RNA
cgctcttccgcgtctcgtcttcatgaacgagaaggaggacatcctgtggtgcactgaaatgtccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53203 - RNA, 296 nt, synthetic construct
  source 1..296: mol_type = other RNA
cgctcttccgcgtctcgtcttcatgaacgagaaggaggacatcctgtggtgcactgaaatggaatccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53204 - RNA, 296 nt, synthetic construct
  source 1..296: mol_type = other RNA
cgctcttccgcgtctcgtcttcatgaacgagaaggaggacatcctgtggtgcactgaaatggaaaggtccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53205 - RNA, 296 nt, synthetic construct
  source 1..296: mol_type = other RNA
cgctcttccgcgtctcgtcttcatgaacgagaaggaggacatcctgtggtgcactgaaatggaaagggtgtcctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53206 - RNA, 296 nt, synthetic construct
  source 1..296: mol_type = other RNA
cgctcttccgcgtctcgtcttcatgaacgagaaggaggacatcctgtggtgcactgaaatggaaagggtgttttccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53207 - RNA, 296 nt, synthetic construct
  source 1..296: mol_type = other RNA
cgctcttccgcgtctcgtcttcatgaacgagaaggaggacatcctgtggtgcactgaaatggaaagggtgtttggctccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53208 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttctcccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53209 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccctccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53210 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtctcccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53211 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactcctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53212 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactactccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53213 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacatccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53214 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagactccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53215 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53216 - RNA, 296 nt, synthetic construct; identical to SEQ ID NO: 53215
  source 1..296: mol_type = other RNA

SEQ ID NO: 53217 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaactccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53218 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgtccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53219 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagctcccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53220 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgctccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53221 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgtccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53222 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgtccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53223 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggtcccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53224 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagtccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53225 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagatccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53226 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgtccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53227 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgtccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53228 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctcccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53229 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53230 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtcctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53231 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggtccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53232 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagctccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53233 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgtccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53234 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgtccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53235 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtctccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53236 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatctcccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53237 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgctcccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53238 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccactccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53239 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctctccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53240 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttctccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53241 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcttccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53242 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgtccctgaaggaatattttgcttgtgtgtctagcggcaatagtaacgctaacagccgcgggccgagcttcagcagcggcctggtgccgttaagcttgcgcgagacgtcggaagagc

SEQ ID NO: 53243 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgtccaaggaatattttgcttgtgtgtctagcggcaatagtaacgctaacagccgcgggccgagcttcagcagcggcctggtgccgttaagcttgcgcgagacgtcggaagagc

SEQ ID NO: 53244 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtccgaatattttgcttgtgtgtctagcggcaatagtaacgctaacagccgcgggccgagcttcagcagcggcctggtgccgttaagcttgcgcgagacgtcggaagagc

SEQ ID NO: 53245 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatcctattttgcttgtgtgtctagcggcaatagtaacgctaacagccgcgggccgagcttcagcagcggcctggtgccgttaagcttgcgcgagacgtcggaagagc

SEQ ID NO: 53246 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattcctttgcttgtgtgtctagcggcaatagtaacgctaacagccgcgggccgagcttcagcagcggcctggtgccgttaagcttgcgcgagacgtcggaagagc

SEQ ID NO: 53247 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttccgcttgtgtgtctagcggcaatagtaacgctaacagccgcgggccgagcttcagcagcggcctggtgccgttaagcttgcgcgagacgtcggaagagc

SEQ ID NO: 53248 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttcctgtgtgtctagcggcaatagtaacgctaacagccgcgggccgagcttcagcagcggcctggtgccgttaagcttgcgcgagacgtcggaagagc

SEQ ID NO: 53249 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttccgtgtctagcggcaatagtaacgctaacagccgcgggccgagcttcagcagcggcctggtgccgttaagcttgcgcgagacgtcggaagagc

SEQ ID NO: 53250 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcctctagcggcaatagtaacgctaacagccgcgggccgagcttcagcagcggcctggtgccgttaagcttgcgcgagacgtcggaagagc

SEQ ID NO: 53251 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtcttccagcggcaatagtaacgctaacagccgcgggccgagcttcagcagcggcctggtgccgttaagcttgcgcgagacgtcggaagagc

SEQ ID NO: 53252 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagctccggcaatagtaacgctaacagccgcgggccgagcttcagcagcggcctggtgccgttaagcttgcgcgagacgtcggaagagc

SEQ ID NO: 53253 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggctccaatagtaacgctaacagccgcgggccgagcttcagcagcggcctggtgccgttaagcttgcgcgagacgtcggaagagc

SEQ ID NO: 53254 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaattccagtaacgctaacagccgcgggccgagcttcagcagcggcctggtgccgttaagcttgcgcgagacgtcggaagagc

SEQ ID NO: 53255 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagttccaacgctaacagccgcgggccgagcttcagcagcggcctggtgccgttaagcttgcgcgagacgtcggaagagc

SEQ ID NO: 53256 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaactccgctaacagccgcgggccgagcttcagcagcggcctggtgccgttaagcttgcgcgagacgtcggaagagc

SEQ ID NO: 53257 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcttccaacagccgcgggccgagcttcagcagcggcctggtgccgttaagcttgcgcgagacgtcggaagagc

SEQ ID NO: 53258 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaactccagccgcgggccgagcttcagcagcggcctggtgccgttaagcttgcgcgagacgtcggaagagc

SEQ ID NO: 53259 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagctcccgcgggccgagcttcagcagcggcctggtgccgttaagcttgcgcgagacgtcggaagagc

SEQ ID NO: 53260 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgctccgggccgagcttcagcagcggcctggtgccgttaagcttgcgcgagacgtcggaagagc

SEQ ID NO: 53261 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggtccccgagcttcagcagcggcctggtgccgttaagcttgcgcgagacgtcggaagagc

SEQ ID NO: 53262 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgtccagcttcagcagcggcctggtgccgttaagcttgcgcgagacgtcggaagagc

SEQ ID NO: 53263 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagctccttcagcagcggcctggtgccgttaagcttgcgcgagacgtcggaagagc

SEQ ID NO: 53264 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttctccagcagcggcctggtgccgttaagcttgcgcgagacgtcggaagagc

SEQ ID NO: 53265 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagctccagcggcctggtgccgttaagcttgcgcgagacgtcggaagagc

SEQ ID NO: 53266 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagctccggcctggtgccgttaagcttgcgcgagacgtcggaagagc

SEQ ID NO: 53267 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggctccctggtgccgttaagcttgcgcgagacgtcggaagagc

SEQ ID NO: 53268 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgtccgtgccgttaagcttgcgcgagacgtcggaagagc

SEQ ID NO: 53269 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgtccccgttaagcttgcgcgagacgtcggaagagc

SEQ ID NO: 53270 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgtccttaagcttgcgcgagacgtcggaagagc

SEQ ID NO: 53271 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttatccagcttgcgcgagacgtcggaagagc

SEQ ID NO: 53272 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagctccttgcgcgagacgtcggaagagc

SEQ ID NO: 53273 - RNA, 296 nt, synthetic construct
  source 1..296: mol_type = other RNA
cgctcttccgcgtctcgtcttcatggagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53274 - RNA, 296 nt, synthetic construct
  source 1..296: mol_type = other RNA
cgctcttccgcgtctcgtcttcatgaacgaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53275 - RNA, 296 nt, synthetic construct; identical to SEQ ID NO: 53274
  source 1..296: mol_type = other RNA

SEQ ID NO: 53276 - RNA, 296 nt, synthetic construct
  source 1..296: mol_type = other RNA
cgctcttccgcgtctcgtcttcatgaacgagaaggaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53277 - RNA, 296 nt, synthetic construct; identical to SEQ ID NO: 53276
  source 1..296: mol_type = other RNA

SEQ ID NO: 53278 - RNA, 296 nt, synthetic construct
  source 1..296: mol_type = other RNA
cgctcttccgcgtctcgtcttcatgaacgagaaggaggacgagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53279 - RNA, 296 nt, synthetic construct
  source 1..296: mol_type = other RNA
cgctcttccgcgtctcgtcttcatgaacgagaaggaggacatcgagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53280 - RNA, 296 nt, synthetic construct
  source 1..296: mol_type = other RNA
cgctcttccgcgtctcgtcttcatgaacgagaaggaggacatcctggagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53281 - RNA, 296 nt, synthetic construct
  source 1..296: mol_type = other RNA
cgctcttccgcgtctcgtcttcatgaacgagaaggaggacatcctgtgggagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53282 - RNA, 296 nt, synthetic construct
  source 1..296: mol_type = other RNA
cgctcttccgcgtctcgtcttcatgaacgagaaggaggacatcctgtggtgcgagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53283 - RNA, 296 nt, synthetic construct
  source 1..296: mol_type = other RNA
cgctcttccgcgtctcgtcttcatgaacgagaaggaggacatcctgtggtgcactgaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53284 - RNA, 296 nt, synthetic construct
  source 1..296: mol_type = other RNA
cgctcttccgcgtctcgtcttcatgaacgagaaggaggacatcctgtggtgcactgaagagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53285 - RNA, 296 nt, synthetic construct
  source 1..296: mol_type = other RNA
cgctcttccgcgtctcgtcttcatgaacgagaaggaggacatcctgtggtgcactgaaatggaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53286 - RNA, 296 nt, synthetic construct
  source 1..296: mol_type = other RNA
cgctcttccgcgtctcgtcttcatgaacgagaaggaggacatcctgtggtgcactgaaatggaagagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53287 - RNA, 296 nt, synthetic construct
  source 1..296: mol_type = other RNA
cgctcttccgcgtctcgtcttcatgaacgagaaggaggacatcctgtggtgcactgaaatggaaagggaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53288 - RNA, 296 nt, synthetic construct
  source 1..296: mol_type = other RNA
cgctcttccgcgtctcgtcttcatgaacgagaaggaggacatcctgtggtgcactgaaatggaaagggtggagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53289 - RNA, 296 nt, synthetic construct
  source 1..296: mol_type = other RNA
cgctcttccgcgtctcgtcttcatgaacgagaaggaggacatcctgtggtgcactgaaatggaaagggtgtttgagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53290 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53291 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53292 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53293 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53294 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53295 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53296 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53297 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53298 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53299 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53300 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53301 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53302 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53303 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53304 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53305 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53306 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53307 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53308 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53309 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53310 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53311 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53312 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53313 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53314 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53315 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53316 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53317 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53318 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53319 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53320 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53321 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53322 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53323 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53324 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53325 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggagctgaaggaatattttgcttgtgtgtctagcggcaatagtaacgctaacagccgcgggccgagcttcagcagcggcctggtgccgttaagcttgcgcgagacgtcggaagagc

SEQ ID NO: 53326 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggagaaggaatattttgcttgtgtgtctagcggcaatagtaacgctaacagccgcgggccgagcttcagcagcggcctggtgccgttaagcttgcgcgagacgtcggaagagc

SEQ ID NO: 53327 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaggaatattttgcttgtgtgtctagcggcaatagtaacgctaacagccgcgggccgagcttcagcagcggcctggtgccgttaagcttgcgcgagacgtcggaagagc

SEQ ID NO: 53328 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagagtattttgcttgtgtgtctagcggcaatagtaacgctaacagccgcgggccgagcttcagcagcggcctggtgccgttaagcttgcgcgagacgtcggaagagc

SEQ ID NO: 53329 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgagtttgcttgtgtgtctagcggcaatagtaacgctaacagccgcgggccgagcttcagcagcggcctggtgccgttaagcttgcgcgagacgtcggaagagc

SEQ ID NO: 53330 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgaggcttgtgtgtctagcggcaatagtaacgctaacagccgcgggccgagcttcagcagcggcctggtgccgttaagcttgcgcgagacgtcggaagagc

SEQ ID NO: 53331 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgagtgtgtgtctagcggcaatagtaacgctaacagccgcgggccgagcttcagcagcggcctggtgccgttaagcttgcgcgagacgtcggaagagc

SEQ ID NO: 53332 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgaggtgtctagcggcaatagtaacgctaacagccgcgggccgagcttcagcagcggcctggtgccgttaagcttgcgcgagacgtcggaagagc

SEQ ID NO: 53333 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggagtctagcggcaatagtaacgctaacagccgcgggccgagcttcagcagcggcctggtgccgttaagcttgcgcgagacgtcggaagagc

SEQ ID NO: 53334 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgagagcggcaatagtaacgctaacagccgcgggccgagcttcagcagcggcctggtgccgttaagcttgcgcgagacgtcggaagagc

SEQ ID NO: 53335 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgagggcaatagtaacgctaacagccgcgggccgagcttcagcagcggcctggtgccgttaagcttgcgcgagacgtcggaagagc

SEQ ID NO: 53336 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgagaatagtaacgctaacagccgcgggccgagcttcagcagcggcctggtgccgttaagcttgcgcgagacgtcggaagagc

SEQ ID NO: 53337 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgagagtaacgctaacagccgcgggccgagcttcagcagcggcctggtgccgttaagcttgcgcgagacgtcggaagagc

SEQ ID NO: 53338 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgagaacgctaacagccgcgggccgagcttcagcagcggcctggtgccgttaagcttgcgcgagacgtcggaagagc

SEQ ID NO: 53339 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgaggctaacagccgcgggccgagcttcagcagcggcctggtgccgttaagcttgcgcgagacgtcggaagagc

SEQ ID NO: 53340 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgagaacagccgcgggccgagcttcagcagcggcctggtgccgttaagcttgcgcgagacgtcggaagagc

SEQ ID NO: 53341 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgagagccgcgggccgagcttcagcagcggcctggtgccgttaagcttgcgcgagacgtcggaagagc

SEQ ID NO: 53342 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgagcgcgggccgagcttcagcagcggcctggtgccgttaagcttgcgcgagacgtcggaagagc

SEQ ID NO: 53343 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgaggggccgagcttcagcagcggcctggtgccgttaagcttgcgcgagacgtcggaagagc

SEQ ID NO: 53344 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggagccgagcttcagcagcggcctggtgccgttaagcttgcgcgagacgtcggaagagc

SEQ ID NO: 53345 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggagagcttcagcagcggcctggtgccgttaagcttgcgcgagacgtcggaagagc

SEQ ID NO: 53346 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgagttcagcagcggcctggtgccgttaagcttgcgcgagacgtcggaagagc

SEQ ID NO: 53347 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgagagcagcggcctggtgccgttaagcttgcgcgagacgtcggaagagc

SEQ ID NO: 53348 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgagagcggcctggtgccgttaagcttgcgcgagacgtcggaagagc

SEQ ID NO: 53349 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgagggcctggtgccgttaagcttgcgcgagacgtcggaagagc

SEQ ID NO: 53350 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgagctggtgccgttaagcttgcgcgagacgtcggaagagc

SEQ ID NO: 53351 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggaggtgccgttaagcttgcgcgagacgtcggaagagc

SEQ ID NO: 53352 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggagccgttaagcttgcgcgagacgtcggaagagc

SEQ ID NO: 53353 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggagttaagcttgcgcgagacgtcggaagagc

SEQ ID NO: 53354 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagagagcttgcgcgagacgtcggaagagc

SEQ ID NO: 53355 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgagttgcgcgagacgtcggaagagc

SEQ ID NO: 53356 - RNA, 296 nt, synthetic construct
  source 1..296: mol_type = other RNA
cgctcttccgcgtctcgtcttcatggacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53357 - RNA, 296 nt, synthetic construct
  source 1..296: mol_type = other RNA
cgctcttccgcgtctcgtcttcatgaacgacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53358 - RNA, 296 nt, synthetic construct
  source 1..296: mol_type = other RNA
cgctcttccgcgtctcgtcttcatgaacgaggacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53359 - RNA, 296 nt, synthetic construct
  source 1..296: mol_type = other RNA
cgctcttccgcgtctcgtcttcatgaacgagaaggacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53360 - RNA, 296 nt, synthetic construct
  source 1..296: mol_type = other RNA
cgctcttccgcgtctcgtcttcatgaacgagaaggaggacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53361 - RNA, 296 nt, synthetic construct; identical to SEQ ID NO: 53360
  source 1..296: mol_type = other RNA

SEQ ID NO: 53362 - RNA, 296 nt, synthetic construct
  source 1..296: mol_type = other RNA
cgctcttccgcgtctcgtcttcatgaacgagaaggaggacatcgacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53363 - RNA, 296 nt, synthetic construct
  source 1..296: mol_type = other RNA
cgctcttccgcgtctcgtcttcatgaacgagaaggaggacatcctggactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53364 - RNA, 296 nt, synthetic construct
  source 1..296: mol_type = other RNA
cgctcttccgcgtctcgtcttcatgaacgagaaggaggacatcctgtgggactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53365 - RNA, 296 nt, synthetic construct
  source 1..296: mol_type = other RNA
cgctcttccgcgtctcgtcttcatgaacgagaaggaggacatcctgtggtgcgacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53366 - RNA, 296 nt, synthetic construct
  source 1..296: mol_type = other RNA
cgctcttccgcgtctcgtcttcatgaacgagaaggaggacatcctgtggtgcactgacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53367 - RNA, 296 nt, synthetic construct
  source 1..296: mol_type = other RNA
cgctcttccgcgtctcgtcttcatgaacgagaaggaggacatcctgtggtgcactgaagacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53368 - RNA, 296 nt, synthetic construct
  source 1..296: mol_type = other RNA
cgctcttccgcgtctcgtcttcatgaacgagaaggaggacatcctgtggtgcactgaaatggacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53369 - RNA, 296 nt, synthetic construct
  source 1..296: mol_type = other RNA
cgctcttccgcgtctcgtcttcatgaacgagaaggaggacatcctgtggtgcactgaaatggaagacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53370 - RNA, 296 nt, synthetic construct
  source 1..296: mol_type = other RNA
cgctcttccgcgtctcgtcttcatgaacgagaaggaggacatcctgtggtgcactgaaatggaaagggacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53371 - RNA, 296 nt, synthetic construct
  source 1..296: mol_type = other RNA
cgctcttccgcgtctcgtcttcatgaacgagaaggaggacatcctgtggtgcactgaaatggaaagggtggactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53372 - RNA, 296 nt, synthetic construct
  source 1..296: mol_type = other RNA
cgctcttccgcgtctcgtcttcatgaacgagaaggaggacatcctgtggtgcactgaaatggaaagggtgtttgacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53373 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53374 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53375 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53376 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53377 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53378 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53379 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53380 - RNA, 296 nt, synthetic construct; identical to SEQ ID NO: 53379
  source 1..296: mol_type = other RNA

SEQ ID NO: 53381 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53382 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53383 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53384 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53385 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53386 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53387 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53388 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53389 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53390 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53391 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53392 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53393 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53394 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53395 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53396 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53397 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53398 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53399 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53400 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53401 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53402 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53403 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53404 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53405 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53406 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53407 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53408 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggacctgaaggaatattttgcttgtgtgtctagcggcaatagtaacgctaacagccgcgggccgagcttcagcagcggcctggtgccgttaagcttgcgcgagacgtcggaagagc

SEQ ID NO: 53409 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggacaaggaatattttgcttgtgtgtctagcggcaatagtaacgctaacagccgcgggccgagcttcagcagcggcctggtgccgttaagcttgcgcgagacgtcggaagagc

SEQ ID NO: 53410 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggacgaatattttgcttgtgtgtctagcggcaatagtaacgctaacagccgcgggccgagcttcagcagcggcctggtgccgttaagcttgcgcgagacgtcggaagagc

SEQ ID NO: 53411 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagactattttgcttgtgtgtctagcggcaatagtaacgctaacagccgcgggccgagcttcagcagcggcctggtgccgttaagcttgcgcgagacgtcggaagagc

SEQ ID NO: 53412 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgactttgcttgtgtgtctagcggcaatagtaacgctaacagccgcgggccgagcttcagcagcggcctggtgccgttaagcttgcgcgagacgtcggaagagc

SEQ ID NO: 53413 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgacgcttgtgtgtctagcggcaatagtaacgctaacagccgcgggccgagcttcagcagcggcctggtgccgttaagcttgcgcgagacgtcggaagagc

SEQ ID NO: 53414 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgactgtgtgtctagcggcaatagtaacgctaacagccgcgggccgagcttcagcagcggcctggtgccgttaagcttgcgcgagacgtcggaagagc

SEQ ID NO: 53415 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgacgtgtctagcggcaatagtaacgctaacagccgcgggccgagcttcagcagcggcctggtgccgttaagcttgcgcgagacgtcggaagagc

SEQ ID NO: 53416 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggactctagcggcaatagtaacgctaacagccgcgggccgagcttcagcagcggcctggtgccgttaagcttgcgcgagacgtcggaagagc

SEQ ID NO: 53417 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgacagcggcaatagtaacgctaacagccgcgggccgagcttcagcagcggcctggtgccgttaagcttgcgcgagacgtcggaagagc

SEQ ID NO: 53418 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgacggcaatagtaacgctaacagccgcgggccgagcttcagcagcggcctggtgccgttaagcttgcgcgagacgtcggaagagc

SEQ ID NO: 53419 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgacaatagtaacgctaacagccgcgggccgagcttcagcagcggcctggtgccgttaagcttgcgcgagacgtcggaagagc

SEQ ID NO: 53420 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgacagtaacgctaacagccgcgggccgagcttcagcagcggcctggtgccgttaagcttgcgcgagacgtcggaagagc

SEQ ID NO: 53421 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgacaacgctaacagccgcgggccgagcttcagcagcggcctggtgccgttaagcttgcgcgagacgtcggaagagc

SEQ ID NO: 53422 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgacgctaacagccgcgggccgagcttcagcagcggcctggtgccgttaagcttgcgcgagacgtcggaagagc

SEQ ID NO: 53423 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgacaacagccgcgggccgagcttcagcagcggcctggtgccgttaagcttgcgcgagacgtcggaagagc

SEQ ID NO: 53424 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgacagccgcgggccgagcttcagcagcggcctggtgccgttaagcttgcgcgagacgtcggaagagc

SEQ ID NO: 53425 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgaccgcgggccgagcttcagcagcggcctggtgccgttaagcttgcgcgagacgtcggaagagc

SEQ ID NO: 53426 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgacgggccgagcttcagcagcggcctggtgccgttaagcttgcgcgagacgtcggaagagc

SEQ ID NO: 53427 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggacccgagcttcagcagcggcctggtgccgttaagcttgcgcgagacgtcggaagagc

SEQ ID NO: 53428 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggacagcttcagcagcggcctggtgccgttaagcttgcgcgagacgtcggaagagc

SEQ ID NO: 53429 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgacttcagcagcggcctggtgccgttaagcttgcgcgagacgtcggaagagc

SEQ ID NO: 53430 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgacagcagcggcctggtgccgttaagcttgcgcgagacgtcggaagagc

SEQ ID NO: 53431 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgacagcggcctggtgccgttaagcttgcgcgagacgtcggaagagc

SEQ ID NO: 53432 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgacggcctggtgccgttaagcttgcgcgagacgtcggaagagc

SEQ ID NO: 53433 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgacctggtgccgttaagcttgcgcgagacgtcggaagagc

SEQ ID NO: 53434 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggacgtgccgttaagcttgcgcgagacgtcggaagagc

SEQ ID NO: 53435 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggacccgttaagcttgcgcgagacgtcggaagagc

SEQ ID NO: 53436 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggacttaagcttgcgcgagacgtcggaagagc

SEQ ID NO: 53437 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagacagcttgcgcgagacgtcggaagagc

SEQ ID NO: 53438 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgacttgcgcgagacgtcggaagagc

SEQ ID NO: 53439 - RNA, 296 nt, synthetic construct
  source 1..296: mol_type = other RNA
cgctcttccgcgtctcgtcttcatggtgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53440 - RNA, 296 nt, synthetic construct
  source 1..296: mol_type = other RNA
cgctcttccgcgtctcgtcttcatgaacgtggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53441 - RNA, 296 nt, synthetic construct
  source 1..296: mol_type = other RNA
cgctcttccgcgtctcgtcttcatgaacgaggtgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53442 - RNA, 296 nt, synthetic construct
  source 1..296: mol_type = other RNA
cgctcttccgcgtctcgtcttcatgaacgagaaggtggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53443 - RNA, 296 nt, synthetic construct
  source 1..296: mol_type = other RNA
cgctcttccgcgtctcgtcttcatgaacgagaaggaggtggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53444 - RNA, 296 nt, synthetic construct
  source 1..296: mol_type = other RNA
cgctcttccgcgtctcgtcttcatgaacgagaaggaggacgtgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53445 - RNA, 296 nt, synthetic construct
  source 1..296: mol_type = other RNA
cgctcttccgcgtctcgtcttcatgaacgagaaggaggacatcgtgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53446 - RNA, 296 nt, synthetic construct
  source 1..296: mol_type = other RNA
cgctcttccgcgtctcgtcttcatgaacgagaaggaggacatcctggtgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53447 - RNA, 296 nt, synthetic construct
  source 1..296: mol_type = other RNA
cgctcttccgcgtctcgtcttcatgaacgagaaggaggacatcctgtgggtgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53448 - RNA, 296 nt, synthetic construct
  source 1..296: mol_type = other RNA
cgctcttccgcgtctcgtcttcatgaacgagaaggaggacatcctgtggtgcgtgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53449 - RNA, 296 nt, synthetic construct
  source 1..296: mol_type = other RNA
cgctcttccgcgtctcgtcttcatgaacgagaaggaggacatcctgtggtgcactgtggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53450 - RNA, 296 nt, synthetic construct
  source 1..296: mol_type = other RNA
cgctcttccgcgtctcgtcttcatgaacgagaaggaggacatcctgtggtgcactgaagtgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53451 - RNA, 296 nt, synthetic construct
  source 1..296: mol_type = other RNA
cgctcttccgcgtctcgtcttcatgaacgagaaggaggacatcctgtggtgcactgaaatggtggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53452 - RNA, 296 nt, synthetic construct
  source 1..296: mol_type = other RNA
cgctcttccgcgtctcgtcttcatgaacgagaaggaggacatcctgtggtgcactgaaatggaagtgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53453 - RNA, 296 nt, synthetic construct
  source 1..296: mol_type = other RNA
cgctcttccgcgtctcgtcttcatgaacgagaaggaggacatcctgtggtgcactgaaatggaaagggtggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53454 - RNA, 296 nt, synthetic construct; identical to SEQ ID NO: 53453
  source 1..296: mol_type = other RNA

SEQ ID NO: 53455 - RNA, 296 nt, synthetic construct
  source 1..296: mol_type = other RNA
cgctcttccgcgtctcgtcttcatgaacgagaaggaggacatcctgtggtgcactgaaatggaaagggtgtttgtgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53456 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgtgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53457 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgtgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53458 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53459 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgtgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53460 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgtgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53461 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgtgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53462 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagtggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53463 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53464 - RNA, 296 nt, synthetic construct; identical to SEQ ID NO: 53463
  source 1..296: mol_type = other RNA

SEQ ID NO: 53465 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgtgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53466 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgtgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53467 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggtgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53468 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgtgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53469 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgtgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53470 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggtggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53471 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggtgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53472 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggtgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53473 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggtgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53474 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagtgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53475 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggtgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53476 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggtgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53477 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgtgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53478 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggtgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53479 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggtgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53480 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggtgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53481 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53482 - RNA, 296 nt, synthetic construct; identical to SEQ ID NO: 53481
  source 1..296: mol_type = other RNA

SEQ ID NO: 53483 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53484 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgtgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53485 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgtgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53486 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgtgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53487 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgtgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53488 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgtgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53489 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgtggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53490 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgtgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53491 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggtgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53492 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggtgaaggaatattttgcttgtgtgtctagcggcaatagtaacgctaacagccgcgggccgagcttcagcagcggcctggtgccgttaagcttgcgcgagacgtcggaagagc

SEQ ID NO: 53493 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggtggaatattttgcttgtgtgtctagcggcaatagtaacgctaacagccgcgggccgagcttcagcagcggcctggtgccgttaagcttgcgcgagacgtcggaagagc

SEQ ID NO: 53494 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagtgtattttgcttgtgtgtctagcggcaatagtaacgctaacagccgcgggccgagcttcagcagcggcctggtgccgttaagcttgcgcgagacgtcggaagagc

SEQ ID NO: 53495 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgtgtttgcttgtgtgtctagcggcaatagtaacgctaacagccgcgggccgagcttcagcagcggcctggtgccgttaagcttgcgcgagacgtcggaagagc

SEQ ID NO: 53496 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgtggcttgtgtgtctagcggcaatagtaacgctaacagccgcgggccgagcttcagcagcggcctggtgccgttaagcttgcgcgagacgtcggaagagc

SEQ ID NO: 53497 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgtgtgtgtgtctagcggcaatagtaacgctaacagccgcgggccgagcttcagcagcggcctggtgccgttaagcttgcgcgagacgtcggaagagc

SEQ ID NO: 53498 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggtgtctagcggcaatagtaacgctaacagccgcgggccgagcttcagcagcggcctggtgccgttaagcttgcgcgagacgtcggaagagc

SEQ ID NO: 53499 - RNA, 296 nt, synthetic construct; identical to SEQ ID NO: 53498
  source 1..296: mol_type = other RNA

SEQ ID NO: 53500 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgtgagcggcaatagtaacgctaacagccgcgggccgagcttcagcagcggcctggtgccgttaagcttgcgcgagacgtcggaagagc

SEQ ID NO: 53501 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgtgggcaatagtaacgctaacagccgcgggccgagcttcagcagcggcctggtgccgttaagcttgcgcgagacgtcggaagagc

SEQ ID NO: 53502 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgtgaatagtaacgctaacagccgcgggccgagcttcagcagcggcctggtgccgttaagcttgcgcgagacgtcggaagagc

SEQ ID NO: 53503 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgtgagtaacgctaacagccgcgggccgagcttcagcagcggcctggtgccgttaagcttgcgcgagacgtcggaagagc

SEQ ID NO: 53504 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgtgaacgctaacagccgcgggccgagcttcagcagcggcctggtgccgttaagcttgcgcgagacgtcggaagagc

SEQ ID NO: 53505 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgtggctaacagccgcgggccgagcttcagcagcggcctggtgccgttaagcttgcgcgagacgtcggaagagc

SEQ ID NO: 53506 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgtgaacagccgcgggccgagcttcagcagcggcctggtgccgttaagcttgcgcgagacgtcggaagagc

SEQ ID NO: 53507 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgtgagccgcgggccgagcttcagcagcggcctggtgccgttaagcttgcgcgagacgtcggaagagc

SEQ ID NO: 53508 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgtgcgcgggccgagcttcagcagcggcctggtgccgttaagcttgcgcgagacgtcggaagagc

SEQ ID NO: 53509 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgtggggccgagcttcagcagcggcctggtgccgttaagcttgcgcgagacgtcggaagagc

SEQ ID NO: 53510 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggtgccgagcttcagcagcggcctggtgccgttaagcttgcgcgagacgtcggaagagc

SEQ ID NO: 53511 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggtgagcttcagcagcggcctggtgccgttaagcttgcgcgagacgtcggaagagc

SEQ ID NO: 53512 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgtgttcagcagcggcctggtgccgttaagcttgcgcgagacgtcggaagagc

SEQ ID NO: 53513 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgtgagcagcggcctggtgccgttaagcttgcgcgagacgtcggaagagc

SEQ ID NO: 53514 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgtgagcggcctggtgccgttaagcttgcgcgagacgtcggaagagc

SEQ ID NO: 53515 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgtgggcctggtgccgttaagcttgcgcgagacgtcggaagagc

SEQ ID NO: 53516 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgtgctggtgccgttaagcttgcgcgagacgtcggaagagc

SEQ ID NO: 53517 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggtgccgttaagcttgcgcgagacgtcggaagagc

SEQ ID NO: 53518 - RNA, 296 nt, synthetic construct; identical to SEQ ID NO: 53517
  source 1..296: mol_type = other RNA

SEQ ID NO: 53519 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggtgttaagcttgcgcgagacgtcggaagagc

SEQ ID NO: 53520 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagtgagcttgcgcgagacgtcggaagagc

SEQ ID NO: 53521 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgtgttgcgcgagacgtcggaagagc

SEQ ID NO: 53522 - RNA, 296 nt, synthetic construct
  source 1..296: mol_type = other RNA
cgctcttccgcgtctcgtcttcatggtcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53523 - RNA, 296 nt, synthetic construct
  source 1..296: mol_type = other RNA
cgctcttccgcgtctcgtcttcatgaacgtcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53524 - RNA, 296 nt, synthetic construct
  source 1..296: mol_type = other RNA
cgctcttccgcgtctcgtcttcatgaacgaggtcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53525 - RNA, 296 nt, synthetic construct
  source 1..296: mol_type = other RNA
cgctcttccgcgtctcgtcttcatgaacgagaaggtcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53526 - RNA, 296 nt, synthetic construct
  source 1..296: mol_type = other RNA
cgctcttccgcgtctcgtcttcatgaacgagaaggaggtcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53527 - RNA, 296 nt, synthetic construct
  source 1..296: mol_type = other RNA
cgctcttccgcgtctcgtcttcatgaacgagaaggaggacgtcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53528 - RNA, 296 nt, synthetic construct
  source 1..296: mol_type = other RNA
cgctcttccgcgtctcgtcttcatgaacgagaaggaggacatcgtcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53529 - RNA, 296 nt, synthetic construct
  source 1..296: mol_type = other RNA
cgctcttccgcgtctcgtcttcatgaacgagaaggaggacatcctggtctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53530 - RNA, 296 nt, synthetic construct
  source 1..296: mol_type = other RNA
cgctcttccgcgtctcgtcttcatgaacgagaaggaggacatcctgtgggtctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53531 - RNA, 296 nt, synthetic construct
  source 1..296: mol_type = other RNA
cgctcttccgcgtctcgtcttcatgaacgagaaggaggacatcctgtggtgcgtcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53532 - RNA, 296 nt, synthetic construct
  source 1..296: mol_type = other RNA
cgctcttccgcgtctcgtcttcatgaacgagaaggaggacatcctgtggtgcactgtcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53533 - RNA, 296 nt, synthetic construct
  source 1..296: mol_type = other RNA
cgctcttccgcgtctcgtcttcatgaacgagaaggaggacatcctgtggtgcactgaagtcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53534 - RNA, 296 nt, synthetic construct
  source 1..296: mol_type = other RNA
cgctcttccgcgtctcgtcttcatgaacgagaaggaggacatcctgtggtgcactgaaatggtcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53535 - RNA, 296 nt, synthetic construct
  source 1..296: mol_type = other RNA
cgctcttccgcgtctcgtcttcatgaacgagaaggaggacatcctgtggtgcactgaaatggaagtcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53536 - RNA, 296 nt, synthetic construct
  source 1..296: mol_type = other RNA
cgctcttccgcgtctcgtcttcatgaacgagaaggaggacatcctgtggtgcactgaaatggaaagggtcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53537 - RNA, 296 nt, synthetic construct
  source 1..296: mol_type = other RNA
cgctcttccgcgtctcgtcttcatgaacgagaaggaggacatcctgtggtgcactgaaatggaaagggtggtctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53538 - RNA, 296 nt, synthetic construct
  source 1..296: mol_type = other RNA
cgctcttccgcgtctcgtcttcatgaacgagaaggaggacatcctgtggtgcactgaaatggaaagggtgtttgtcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53539 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgtcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53540 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgtccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53541 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53542 - RNA, 296 nt, synthetic construct; identical to SEQ ID NO: 53541
  source 1..296: mol_type = other RNA

SEQ ID NO: 53543 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgtctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53544 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgtcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53545 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagtcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53546 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53547 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggtctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53548 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgtcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53549 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgtcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53550 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggtcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53551 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgtccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53552 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgtcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53553 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggtcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53554 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggtcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53555 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggtccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53556 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggtcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53557 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagtcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53558 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggtcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53559 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggtcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53560 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgtccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53561 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggtctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53562 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggtctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53563 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggtcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53564 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53565 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggtcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53566 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53567 - RNA, 296 nt, synthetic construct; identical to SEQ ID NO: 53566
  source 1..296: mol_type = other RNA

SEQ ID NO: 53568 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgtccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53569 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgtccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53570 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgtcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53571 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgtcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53572 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgtcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53573 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgtcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53574 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggtcctgaaggaatattttgcttgtgtgtctagcggcaatagtaacgctaacagccgcgggccgagcttcagcagcggcctggtgccgttaagcttgcgcgagacgtcggaagagc

SEQ ID NO: 53575 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggtcaaggaatattttgcttgtgtgtctagcggcaatagtaacgctaacagccgcgggccgagcttcagcagcggcctggtgccgttaagcttgcgcgagacgtcggaagagc

SEQ ID NO: 53576 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggtcgaatattttgcttgtgtgtctagcggcaatagtaacgctaacagccgcgggccgagcttcagcagcggcctggtgccgttaagcttgcgcgagacgtcggaagagc

SEQ ID NO: 53577 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagtctattttgcttgtgtgtctagcggcaatagtaacgctaacagccgcgggccgagcttcagcagcggcctggtgccgttaagcttgcgcgagacgtcggaagagc

SEQ ID NO: 53578 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgtctttgcttgtgtgtctagcggcaatagtaacgctaacagccgcgggccgagcttcagcagcggcctggtgccgttaagcttgcgcgagacgtcggaagagc

SEQ ID NO: 53579 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgtcgcttgtgtgtctagcggcaatagtaacgctaacagccgcgggccgagcttcagcagcggcctggtgccgttaagcttgcgcgagacgtcggaagagc

SEQ ID NO: 53580 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgtctgtgtgtctagcggcaatagtaacgctaacagccgcgggccgagcttcagcagcggcctggtgccgttaagcttgcgcgagacgtcggaagagc

SEQ ID NO: 53581 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtcgtgtctagcggcaatagtaacgctaacagccgcgggccgagcttcagcagcggcctggtgccgttaagcttgcgcgagacgtcggaagagc

SEQ ID NO: 53582 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggtctctagcggcaatagtaacgctaacagccgcgggccgagcttcagcagcggcctggtgccgttaagcttgcgcgagacgtcggaagagc

SEQ ID NO: 53583 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgtcagcggcaatagtaacgctaacagccgcgggccgagcttcagcagcggcctggtgccgttaagcttgcgcgagacgtcggaagagc

SEQ ID NO: 53584 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgtcggcaatagtaacgctaacagccgcgggccgagcttcagcagcggcctggtgccgttaagcttgcgcgagacgtcggaagagc

SEQ ID NO: 53585 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgtcaatagtaacgctaacagccgcgggccgagcttcagcagcggcctggtgccgttaagcttgcgcgagacgtcggaagagc

SEQ ID NO: 53586 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgtcagtaacgctaacagccgcgggccgagcttcagcagcggcctggtgccgttaagcttgcgcgagacgtcggaagagc

SEQ ID NO: 53587 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgtcaacgctaacagccgcgggccgagcttcagcagcggcctggtgccgttaagcttgcgcgagacgtcggaagagc

SEQ ID NO: 53588 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgtcgctaacagccgcgggccgagcttcagcagcggcctggtgccgttaagcttgcgcgagacgtcggaagagc

SEQ ID NO: 53589 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgtcaacagccgcgggccgagcttcagcagcggcctggtgccgttaagcttgcgcgagacgtcggaagagc

SEQ ID NO: 53590 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgtcagccgcgggccgagcttcagcagcggcctggtgccgttaagcttgcgcgagacgtcggaagagc

SEQ ID NO: 53591 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgtccgcgggccgagcttcagcagcggcctggtgccgttaagcttgcgcgagacgtcggaagagc

SEQ ID NO: 53592 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgtcgggccgagcttcagcagcggcctggtgccgttaagcttgcgcgagacgtcggaagagc

SEQ ID NO: 53593 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggtcccgagcttcagcagcggcctggtgccgttaagcttgcgcgagacgtcggaagagc

SEQ ID NO: 53594 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggtcagcttcagcagcggcctggtgccgttaagcttgcgcgagacgtcggaagagc

SEQ ID NO: 53595 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgtcttcagcagcggcctggtgccgttaagcttgcgcgagacgtcggaagagc

SEQ ID NO: 53596 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgtcagcagcggcctggtgccgttaagcttgcgcgagacgtcggaagagc

SEQ ID NO: 53597 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgtcagcggcctggtgccgttaagcttgcgcgagacgtcggaagagc

SEQ ID NO: 53598 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgtcggcctggtgccgttaagcttgcgcgagacgtcggaagagc

SEQ ID NO: 53599 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgtcctggtgccgttaagcttgcgcgagacgtcggaagagc

SEQ ID NO: 53600 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtcgtgccgttaagcttgcgcgagacgtcggaagagc

SEQ ID NO: 53601 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggtcccgttaagcttgcgcgagacgtcggaagagc

SEQ ID NO: 53602 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggtcttaagcttgcgcgagacgtcggaagagc

SEQ ID NO: 53603 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagtcagcttgcgcgagacgtcggaagagc

SEQ ID NO: 53604 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgtcttgcgcgagacgtcggaagagc

SEQ ID NO: 53605 - RNA, 296 nt, synthetic construct
  source 1..296: mol_type = other RNA
cgctcttccgcgtctcgtcttcatggggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53606 - RNA, 296 nt, synthetic construct
  source 1..296: mol_type = other RNA
cgctcttccgcgtctcgtcttcatgaacggggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53607 - RNA, 296 nt, synthetic construct
  source 1..296: mol_type = other RNA
cgctcttccgcgtctcgtcttcatgaacgaggggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53608 - RNA, 296 nt, synthetic construct
  source 1..296: mol_type = other RNA
cgctcttccgcgtctcgtcttcatgaacgagaagggggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53609 - RNA, 296 nt, synthetic construct
  source 1..296: mol_type = other RNA
cgctcttccgcgtctcgtcttcatgaacgagaaggagggggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53610 - RNA, 296 nt, synthetic construct
  source 1..296: mol_type = other RNA
cgctcttccgcgtctcgtcttcatgaacgagaaggaggacgggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53611 - RNA, 296 nt, synthetic construct
  source 1..296: mol_type = other RNA
cgctcttccgcgtctcgtcttcatgaacgagaaggaggacatcgggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53612 - RNA, 296 nt, synthetic construct
  source 1..296: mol_type = other RNA
cgctcttccgcgtctcgtcttcatgaacgagaaggaggacatcctggggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53613 - RNA, 296 nt, synthetic construct
  source 1..296: mol_type = other RNA
cgctcttccgcgtctcgtcttcatgaacgagaaggaggacatcctgtgggggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53614 - RNA, 296 nt, synthetic construct
  source 1..296: mol_type = other RNA
cgctcttccgcgtctcgtcttcatgaacgagaaggaggacatcctgtggtgcgggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53615 - RNA, 296 nt, synthetic construct
  source 1..296: mol_type = other RNA
cgctcttccgcgtctcgtcttcatgaacgagaaggaggacatcctgtggtgcactggggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53616 - RNA, 296 nt, synthetic construct
  source 1..296: mol_type = other RNA
cgctcttccgcgtctcgtcttcatgaacgagaaggaggacatcctgtggtgcactgaagggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53617 - RNA, 296 nt, synthetic construct
  source 1..296: mol_type = other RNA
cgctcttccgcgtctcgtcttcatgaacgagaaggaggacatcctgtggtgcactgaaatgggggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53618 - RNA, 296 nt, synthetic construct
  source 1..296: mol_type = other RNA
cgctcttccgcgtctcgtcttcatgaacgagaaggaggacatcctgtggtgcactgaaatggaagggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53619 - RNA, 296 nt, synthetic construct
  source 1..296: mol_type = other RNA
cgctcttccgcgtctcgtcttcatgaacgagaaggaggacatcctgtggtgcactgaaatggaaaggggggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53620 - RNA, 296 nt, synthetic construct
  source 1..296: mol_type = other RNA
cgctcttccgcgtctcgtcttcatgaacgagaaggaggacatcctgtggtgcactgaaatggaaagggtggggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53621 - RNA, 296 nt, synthetic construct
  source 1..296: mol_type = other RNA
cgctcttccgcgtctcgtcttcatgaacgagaaggaggacatcctgtggtgcactgaaatggaaagggtgtttgggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53622 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53623 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53624 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccggggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53625 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53626 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53627 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53628 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaggggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53629 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacggggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53630 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53631 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53632 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53633 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53634 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53635 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53636 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgggggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53637 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53638 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53639 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53640 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53641 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53642 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53643 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53644 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53645 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53646 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53647 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcggggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53648 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53649 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgggggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53650 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53651 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53652 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53653 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53654 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53655 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcggggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53656 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53657 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggggctgaaggaatattttgcttgtgtgtctagcggcaatagtaacgctaacagccgcgggccgagcttcagcagcggcctggtgccgttaagcttgcgcgagacgtcggaagagc

SEQ ID NO: 53658 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggggaaggaatattttgcttgtgtgtctagcggcaatagtaacgctaacagccgcgggccgagcttcagcagcggcctggtgccgttaagcttgcgcgagacgtcggaagagc

SEQ ID NO: 53659 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagggggaatattttgcttgtgtgtctagcggcaatagtaacgctaacagccgcgggccgagcttcagcagcggcctggtgccgttaagcttgcgcgagacgtcggaagagc

SEQ ID NO: 53660 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagggtattttgcttgtgtgtctagcggcaatagtaacgctaacagccgcgggccgagcttcagcagcggcctggtgccgttaagcttgcgcgagacgtcggaagagc

SEQ ID NO: 53661 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgggtttgcttgtgtgtctagcggcaatagtaacgctaacagccgcgggccgagcttcagcagcggcctggtgccgttaagcttgcgcgagacgtcggaagagc

SEQ ID NO: 53662 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttggggcttgtgtgtctagcggcaatagtaacgctaacagccgcgggccgagcttcagcagcggcctggtgccgttaagcttgcgcgagacgtcggaagagc

SEQ ID NO: 53663 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgggtgtgtgtctagcggcaatagtaacgctaacagccgcgggccgagcttcagcagcggcctggtgccgttaagcttgcgcgagacgtcggaagagc

SEQ ID NO: 53664 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtggggtgtctagcggcaatagtaacgctaacagccgcgggccgagcttcagcagcggcctggtgccgttaagcttgcgcgagacgtcggaagagc

SEQ ID NO: 53665 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggggtctagcggcaatagtaacgctaacagccgcgggccgagcttcagcagcggcctggtgccgttaagcttgcgcgagacgtcggaagagc

SEQ ID NO: 53666 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgggagcggcaatagtaacgctaacagccgcgggccgagcttcagcagcggcctggtgccgttaagcttgcgcgagacgtcggaagagc

SEQ ID NO: 53667 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgggggcaatagtaacgctaacagccgcgggccgagcttcagcagcggcctggtgccgttaagcttgcgcgagacgtcggaagagc

SEQ ID NO: 53668 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgggaatagtaacgctaacagccgcgggccgagcttcagcagcggcctggtgccgttaagcttgcgcgagacgtcggaagagc

SEQ ID NO: 53669 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgggagtaacgctaacagccgcgggccgagcttcagcagcggcctggtgccgttaagcttgcgcgagacgtcggaagagc

SEQ ID NO: 53670 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgggaacgctaacagccgcgggccgagcttcagcagcggcctggtgccgttaagcttgcgcgagacgtcggaagagc

SEQ ID NO: 53671 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacggggctaacagccgcgggccgagcttcagcagcggcctggtgccgttaagcttgcgcgagacgtcggaagagc

SEQ ID NO: 53672 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgggaacagccgcgggccgagcttcagcagcggcctggtgccgttaagcttgcgcgagacgtcggaagagc

SEQ ID NO: 53673 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgggagccgcgggccgagcttcagcagcggcctggtgccgttaagcttgcgcgagacgtcggaagagc

SEQ ID NO: 53674 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgggcgcgggccgagcttcagcagcggcctggtgccgttaagcttgcgcgagacgtcggaagagc

SEQ ID NO: 53675 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggggccgagcttcagcagcggcctggtgccgttaagcttgcgcgagacgtcggaagagc

SEQ ID NO: 53676 - RNA, 296 nt, synthetic construct; identical to SEQ ID NO: 53675
  source 1..296: mol_type = other RNA

SEQ ID NO: 53677 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggggagcttcagcagcggcctggtgccgttaagcttgcgcgagacgtcggaagagc

SEQ ID NO: 53678 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgggttcagcagcggcctggtgccgttaagcttgcgcgagacgtcggaagagc

SEQ ID NO: 53679 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgggagcagcggcctggtgccgttaagcttgcgcgagacgtcggaagagc

SEQ ID NO: 53680 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgggagcggcctggtgccgttaagcttgcgcgagacgtcggaagagc

SEQ ID NO: 53681 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgggggcctggtgccgttaagcttgcgcgagacgtcggaagagc

SEQ ID NO: 53682 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgggctggtgccgttaagcttgcgcgagacgtcggaagagc

SEQ ID NO: 53683 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgggggtgccgttaagcttgcgcgagacgtcggaagagc

SEQ ID NO: 53684 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggggccgttaagcttgcgcgagacgtcggaagagc

SEQ ID NO: 53685 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggggttaagcttgcgcgagacgtcggaagagc

SEQ ID NO: 53686 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagggagcttgcgcgagacgtcggaagagc

SEQ ID NO: 53687 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgggttgcgcgagacgtcggaagagc

SEQ ID NO: 53688 - RNA, 296 nt, synthetic construct
  source 1..296: mol_type = other RNA
cgctcttccgcgtctcgtcttcatgggcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53689 - RNA, 296 nt, synthetic construct
  source 1..296: mol_type = other RNA
cgctcttccgcgtctcgtcttcatgaacggcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53690 - RNA, 296 nt, synthetic construct
  source 1..296: mol_type = other RNA
cgctcttccgcgtctcgtcttcatgaacgagggcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53691 - RNA, 296 nt, synthetic construct
  source 1..296: mol_type = other RNA
cgctcttccgcgtctcgtcttcatgaacgagaagggcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53692 - RNA, 296 nt, synthetic construct
  source 1..296: mol_type = other RNA
cgctcttccgcgtctcgtcttcatgaacgagaaggagggcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53693 - RNA, 296 nt, synthetic construct
  source 1..296: mol_type = other RNA
cgctcttccgcgtctcgtcttcatgaacgagaaggaggacggcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53694 - RNA, 296 nt, synthetic construct
  source 1..296: mol_type = other RNA
cgctcttccgcgtctcgtcttcatgaacgagaaggaggacatcggcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53695 - RNA, 296 nt, synthetic construct
  source 1..296: mol_type = other RNA
cgctcttccgcgtctcgtcttcatgaacgagaaggaggacatcctgggctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53696 - RNA, 296 nt, synthetic construct
  source 1..296: mol_type = other RNA
cgctcttccgcgtctcgtcttcatgaacgagaaggaggacatcctgtggggctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53697 - RNA, 296 nt, synthetic construct
  source 1..296: mol_type = other RNA
cgctcttccgcgtctcgtcttcatgaacgagaaggaggacatcctgtggtgcggcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53698 - RNA, 296 nt, synthetic construct
  source 1..296: mol_type = other RNA
cgctcttccgcgtctcgtcttcatgaacgagaaggaggacatcctgtggtgcactggcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53699 - RNA, 296 nt, synthetic construct
  source 1..296: mol_type = other RNA
cgctcttccgcgtctcgtcttcatgaacgagaaggaggacatcctgtggtgcactgaaggcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53700 - RNA, 296 nt, synthetic construct
  source 1..296: mol_type = other RNA
cgctcttccgcgtctcgtcttcatgaacgagaaggaggacatcctgtggtgcactgaaatgggcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53701 - RNA, 296 nt, synthetic construct
  source 1..296: mol_type = other RNA
cgctcttccgcgtctcgtcttcatgaacgagaaggaggacatcctgtggtgcactgaaatggaaggcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53702 - RNA, 296 nt, synthetic construct
  source 1..296: mol_type = other RNA
cgctcttccgcgtctcgtcttcatgaacgagaaggaggacatcctgtggtgcactgaaatggaaaggggcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53703 - RNA, 296 nt, synthetic construct
  source 1..296: mol_type = other RNA
cgctcttccgcgtctcgtcttcatgaacgagaaggaggacatcctgtggtgcactgaaatggaaagggtgggctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53704 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53705 - RNA, 296 nt, synthetic construct; identical to SEQ ID NO: 53704
  source 1..296: mol_type = other RNA

SEQ ID NO: 53706 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcggccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53707 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccggcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53708 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcggccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53709 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacggctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53710 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacggcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53711 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaggcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53712 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacggcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53713 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgggctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53714 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccggcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53715 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacggcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53716 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgggcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53717 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcggccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53718 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcggcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53719 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgggcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53720 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgggcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53721 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggggccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53722 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagggcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53723 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaggcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53724 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgggcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53725 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53726 - RNA, 296 nt, synthetic construct; identical to SEQ ID NO: 53725
  source 1..296: mol_type = other RNA

SEQ ID NO: 53727 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggggctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53728 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgggctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53729 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggggcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53730 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcggcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53731 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgggcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53732 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgggcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53733 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcggcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53734 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcggccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53735 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcggccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53736 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacggcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53737 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcggcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53738 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcggcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53739 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctggcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53740 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgggcctgaaggaatattttgcttgtgtgtctagcggcaatagtaacgctaacagccgcgggccgagcttcagcagcggcctggtgccgttaagcttgcgcgagacgtcggaagagc

SEQ ID NO: 53741 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgggcaaggaatattttgcttgtgtgtctagcggcaatagtaacgctaacagccgcgggccgagcttcagcagcggcctggtgccgttaagcttgcgcgagacgtcggaagagc

SEQ ID NO: 53742 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagggcgaatattttgcttgtgtgtctagcggcaatagtaacgctaacagccgcgggccgagcttcagcagcggcctggtgccgttaagcttgcgcgagacgtcggaagagc

SEQ ID NO: 53743 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaggctattttgcttgtgtgtctagcggcaatagtaacgctaacagccgcgggccgagcttcagcagcggcctggtgccgttaagcttgcgcgagacgtcggaagagc

SEQ ID NO: 53744 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatggctttgcttgtgtgtctagcggcaatagtaacgctaacagccgcgggccgagcttcagcagcggcctggtgccgttaagcttgcgcgagacgtcggaagagc

SEQ ID NO: 53745 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttggcgcttgtgtgtctagcggcaatagtaacgctaacagccgcgggccgagcttcagcagcggcctggtgccgttaagcttgcgcgagacgtcggaagagc

SEQ ID NO: 53746 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctggctgtgtgtctagcggcaatagtaacgctaacagccgcgggccgagcttcagcagcggcctggtgccgttaagcttgcgcgagacgtcggaagagc

SEQ ID NO: 53747 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtggcgtgtctagcggcaatagtaacgctaacagccgcgggccgagcttcagcagcggcctggtgccgttaagcttgcgcgagacgtcggaagagc

SEQ ID NO: 53748 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgggctctagcggcaatagtaacgctaacagccgcgggccgagcttcagcagcggcctggtgccgttaagcttgcgcgagacgtcggaagagc

SEQ ID NO: 53749 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctggcagcggcaatagtaacgctaacagccgcgggccgagcttcagcagcggcctggtgccgttaagcttgcgcgagacgtcggaagagc

SEQ ID NO: 53750 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcggcaatagtaacgctaacagccgcgggccgagcttcagcagcggcctggtgccgttaagcttgcgcgagacgtcggaagagc

SEQ ID NO: 53751 - RNA, 296 nt, synthetic construct; identical to SEQ ID NO: 53750
  source 1..296: mol_type = other RNA

SEQ ID NO: 53752 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatggcagtaacgctaacagccgcgggccgagcttcagcagcggcctggtgccgttaagcttgcgcgagacgtcggaagagc

SEQ ID NO: 53753 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtggcaacgctaacagccgcgggccgagcttcagcagcggcctggtgccgttaagcttgcgcgagacgtcggaagagc

SEQ ID NO: 53754 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacggcgctaacagccgcgggccgagcttcagcagcggcctggtgccgttaagcttgcgcgagacgtcggaagagc

SEQ ID NO: 53755 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctggcaacagccgcgggccgagcttcagcagcggcctggtgccgttaagcttgcgcgagacgtcggaagagc

SEQ ID NO: 53756 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacggcagccgcgggccgagcttcagcagcggcctggtgccgttaagcttgcgcgagacgtcggaagagc

SEQ ID NO: 53757 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcggccgcgggccgagcttcagcagcggcctggtgccgttaagcttgcgcgagacgtcggaagagc

SEQ ID NO: 53758 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggcgggccgagcttcagcagcggcctggtgccgttaagcttgcgcgagacgtcggaagagc

SEQ ID NO: 53759 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggggcccgagcttcagcagcggcctggtgccgttaagcttgcgcgagacgtcggaagagc

SEQ ID NO: 53760 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgggcagcttcagcagcggcctggtgccgttaagcttgcgcgagacgtcggaagagc

SEQ ID NO: 53761 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcggcttcagcagcggcctggtgccgttaagcttgcgcgagacgtcggaagagc

SEQ ID NO: 53762 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcggcagcagcggcctggtgccgttaagcttgcgcgagacgtcggaagagc

SEQ ID NO: 53763 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcggcagcggcctggtgccgttaagcttgcgcgagacgtcggaagagc

SEQ ID NO: 53764 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcggcctggtgccgttaagcttgcgcgagacgtcggaagagc

SEQ ID NO: 53765 - RNA, 296 nt, synthetic construct; identical to SEQ ID NO: 53764
  source 1..296: mol_type = other RNA

SEQ ID NO: 53766 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgggcgtgccgttaagcttgcgcgagacgtcggaagagc

SEQ ID NO: 53767 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgggcccgttaagcttgcgcgagacgtcggaagagc

SEQ ID NO: 53768 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgggcttaagcttgcgcgagacgtcggaagagc

SEQ ID NO: 53769 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaggcagcttgcgcgagacgtcggaagagc

SEQ ID NO: 53770 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcggcttgcgcgagacgtcggaagagc

SEQ ID NO: 53771 - RNA, 296 nt, synthetic construct
  source 1..296: mol_type = other RNA
cgctcttccgcgtctcgtcttcatggcgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53772 - RNA, 296 nt, synthetic construct
  source 1..296: mol_type = other RNA
cgctcttccgcgtctcgtcttcatgaacgcggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53773 - RNA, 296 nt, synthetic construct
  source 1..296: mol_type = other RNA
cgctcttccgcgtctcgtcttcatgaacgaggcgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53774 - RNA, 296 nt, synthetic construct
  source 1..296: mol_type = other RNA
cgctcttccgcgtctcgtcttcatgaacgagaaggcggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53775 - RNA, 296 nt, synthetic construct
  source 1..296: mol_type = other RNA
cgctcttccgcgtctcgtcttcatgaacgagaaggaggcggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53776 - RNA, 296 nt, synthetic construct
  source 1..296: mol_type = other RNA
cgctcttccgcgtctcgtcttcatgaacgagaaggaggacgcgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53777 - RNA, 296 nt, synthetic construct
  source 1..296: mol_type = other RNA
cgctcttccgcgtctcgtcttcatgaacgagaaggaggacatcgcgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53778 - RNA, 296 nt, synthetic construct
  source 1..296: mol_type = other RNA
cgctcttccgcgtctcgtcttcatgaacgagaaggaggacatcctggcgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53779 - RNA, 296 nt, synthetic construct
  source 1..296: mol_type = other RNA
cgctcttccgcgtctcgtcttcatgaacgagaaggaggacatcctgtgggcgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53780 - RNA, 296 nt, synthetic construct
  source 1..296: mol_type = other RNA
cgctcttccgcgtctcgtcttcatgaacgagaaggaggacatcctgtggtgcgcgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53781 - RNA, 296 nt, synthetic construct
  source 1..296: mol_type = other RNA
cgctcttccgcgtctcgtcttcatgaacgagaaggaggacatcctgtggtgcactgcggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53782 - RNA, 296 nt, synthetic construct
  source 1..296: mol_type = other RNA
cgctcttccgcgtctcgtcttcatgaacgagaaggaggacatcctgtggtgcactgaagcgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53783 - RNA, 296 nt, synthetic construct
  source 1..296: mol_type = other RNA
cgctcttccgcgtctcgtcttcatgaacgagaaggaggacatcctgtggtgcactgaaatggcggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53784 - RNA, 296 nt, synthetic construct
  source 1..296: mol_type = other RNA
cgctcttccgcgtctcgtcttcatgaacgagaaggaggacatcctgtggtgcactgaaatggaagcgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53785 - RNA, 296 nt, synthetic construct
  source 1..296: mol_type = other RNA
cgctcttccgcgtctcgtcttcatgaacgagaaggaggacatcctgtggtgcactgaaatggaaagggcggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53786 - RNA, 296 nt, synthetic construct
  source 1..296: mol_type = other RNA
cgctcttccgcgtctcgtcttcatgaacgagaaggaggacatcctgtggtgcactgaaatggaaagggtggcgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53787 - RNA, 296 nt, synthetic construct
  source 1..296: mol_type = other RNA
cgctcttccgcgtctcgtcttcatgaacgagaaggaggacatcctgtggtgcactgaaatggaaagggtgtttgcgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53788 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgcgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53789 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgcgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53790 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgcggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53791 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgcgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53792 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgcgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53793 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgcgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53794 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagcggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53795 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgcggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53796 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggcgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53797 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgcgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53798 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgcgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53799 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggcgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53800 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgcgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53801 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgcgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53802 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53803 - RNA, 296 nt, synthetic construct; identical to SEQ ID NO: 53802
  source 1..296: mol_type = other RNA

SEQ ID NO: 53804 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggcgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53805 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggcgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53806 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagcgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53807 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggcgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53808 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggcgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53809 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgcgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53810 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggcgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53811 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53812 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggcgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53813 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgcggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53814 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggcgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53815 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggcggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53816 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgcgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53817 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgcgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53818 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgcgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53819 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgcgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53820 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgcgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53821 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgcggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53822 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgcgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53823 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggcgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53824 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggcgaaggaatattttgcttgtgtgtctagcggcaatagtaacgctaacagccgcgggccgagcttcagcagcggcctggtgccgttaagcttgcgcgagacgtcggaagagc

SEQ ID NO: 53825 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggcggaatattttgcttgtgtgtctagcggcaatagtaacgctaacagccgcgggccgagcttcagcagcggcctggtgccgttaagcttgcgcgagacgtcggaagagc

SEQ ID NO: 53826 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagcgtattttgcttgtgtgtctagcggcaatagtaacgctaacagccgcgggccgagcttcagcagcggcctggtgccgttaagcttgcgcgagacgtcggaagagc

SEQ ID NO: 53827 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgcgtttgcttgtgtgtctagcggcaatagtaacgctaacagccgcgggccgagcttcagcagcggcctggtgccgttaagcttgcgcgagacgtcggaagagc

SEQ ID NO: 53828 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcggcttgtgtgtctagcggcaatagtaacgctaacagccgcgggccgagcttcagcagcggcctggtgccgttaagcttgcgcgagacgtcggaagagc

SEQ ID NO: 53829 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgcgtgtgtgtctagcggcaatagtaacgctaacagccgcgggccgagcttcagcagcggcctggtgccgttaagcttgcgcgagacgtcggaagagc

SEQ ID NO: 53830 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgcggtgtctagcggcaatagtaacgctaacagccgcgggccgagcttcagcagcggcctggtgccgttaagcttgcgcgagacgtcggaagagc

SEQ ID NO: 53831 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggcgtctagcggcaatagtaacgctaacagccgcgggccgagcttcagcagcggcctggtgccgttaagcttgcgcgagacgtcggaagagc

SEQ ID NO: 53832 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgcgagcggcaatagtaacgctaacagccgcgggccgagcttcagcagcggcctggtgccgttaagcttgcgcgagacgtcggaagagc

SEQ ID NO: 53833 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgcgggcaatagtaacgctaacagccgcgggccgagcttcagcagcggcctggtgccgttaagcttgcgcgagacgtcggaagagc

SEQ ID NO: 53834 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgcgaatagtaacgctaacagccgcgggccgagcttcagcagcggcctggtgccgttaagcttgcgcgagacgtcggaagagc

SEQ ID NO: 53835 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgcgagtaacgctaacagccgcgggccgagcttcagcagcggcctggtgccgttaagcttgcgcgagacgtcggaagagc

SEQ ID NO: 53836 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgcgaacgctaacagccgcgggccgagcttcagcagcggcctggtgccgttaagcttgcgcgagacgtcggaagagc

SEQ ID NO: 53837 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgcggctaacagccgcgggccgagcttcagcagcggcctggtgccgttaagcttgcgcgagacgtcggaagagc

SEQ ID NO: 53838 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgcgaacagccgcgggccgagcttcagcagcggcctggtgccgttaagcttgcgcgagacgtcggaagagc

SEQ ID NO: 53839 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgcgagccgcgggccgagcttcagcagcggcctggtgccgttaagcttgcgcgagacgtcggaagagc

SEQ ID NO: 53840 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgcgcgcgggccgagcttcagcagcggcctggtgccgttaagcttgcgcgagacgtcggaagagc

SEQ ID NO: 53841 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgcggggccgagcttcagcagcggcctggtgccgttaagcttgcgcgagacgtcggaagagc

SEQ ID NO: 53842 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggcgccgagcttcagcagcggcctggtgccgttaagcttgcgcgagacgtcggaagagc

SEQ ID NO: 53843 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggcgagcttcagcagcggcctggtgccgttaagcttgcgcgagacgtcggaagagc

SEQ ID NO: 53844 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgcgttcagcagcggcctggtgccgttaagcttgcgcgagacgtcggaagagc

SEQ ID NO: 53845 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgcgagcagcggcctggtgccgttaagcttgcgcgagacgtcggaagagc

SEQ ID NO: 53846 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgcgagcggcctggtgccgttaagcttgcgcgagacgtcggaagagc

SEQ ID NO: 53847 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgcgggcctggtgccgttaagcttgcgcgagacgtcggaagagc

SEQ ID NO: 53848 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgcgctggtgccgttaagcttgcgcgagacgtcggaagagc

SEQ ID NO: 53849 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggcggtgccgttaagcttgcgcgagacgtcggaagagc

SEQ ID NO: 53850 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggcgccgttaagcttgcgcgagacgtcggaagagc

SEQ ID NO: 53851 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggcgttaagcttgcgcgagacgtcggaagagc

SEQ ID NO: 53852 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagcgagcttgcgcgagacgtcggaagagc

SEQ ID NO: 53853 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgcgttgcgcgagacgtcggaagagc

SEQ ID NO: 53854 - RNA, 296 nt, synthetic construct
  source 1..296: mol_type = other RNA
cgctcttccgcgtctcgtcttcatggccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53855 - RNA, 296 nt, synthetic construct
  source 1..296: mol_type = other RNA
cgctcttccgcgtctcgtcttcatgaacgccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53856 - RNA, 296 nt, synthetic construct
  source 1..296: mol_type = other RNA
cgctcttccgcgtctcgtcttcatgaacgaggccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53857 - RNA, 296 nt, synthetic construct
  source 1..296: mol_type = other RNA
cgctcttccgcgtctcgtcttcatgaacgagaaggccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53858 - RNA, 296 nt, synthetic construct
  source 1..296: mol_type = other RNA
cgctcttccgcgtctcgtcttcatgaacgagaaggaggccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53859 - RNA, 296 nt, synthetic construct
  source 1..296: mol_type = other RNA
cgctcttccgcgtctcgtcttcatgaacgagaaggaggacgccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53860 - RNA, 296 nt, synthetic construct
  source 1..296: mol_type = other RNA
cgctcttccgcgtctcgtcttcatgaacgagaaggaggacatcgccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53861 - RNA, 296 nt, synthetic construct
  source 1..296: mol_type = other RNA
cgctcttccgcgtctcgtcttcatgaacgagaaggaggacatcctggcctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53862 - RNA, 296 nt, synthetic construct
  source 1..296: mol_type = other RNA
cgctcttccgcgtctcgtcttcatgaacgagaaggaggacatcctgtgggcctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53863 - RNA, 296 nt, synthetic construct
  source 1..296: mol_type = other RNA
cgctcttccgcgtctcgtcttcatgaacgagaaggaggacatcctgtggtgcgccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53864 - RNA, 296 nt, synthetic construct
  source 1..296: mol_type = other RNA
cgctcttccgcgtctcgtcttcatgaacgagaaggaggacatcctgtggtgcactgccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53865 - RNA, 296 nt, synthetic construct
  source 1..296: mol_type = other RNA
cgctcttccgcgtctcgtcttcatgaacgagaaggaggacatcctgtggtgcactgaagccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53866 - RNA, 296 nt, synthetic construct
  source 1..296: mol_type = other RNA
cgctcttccgcgtctcgtcttcatgaacgagaaggaggacatcctgtggtgcactgaaatggccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53867 - RNA, 296 nt, synthetic construct
  source 1..296: mol_type = other RNA
cgctcttccgcgtctcgtcttcatgaacgagaaggaggacatcctgtggtgcactgaaatggaagccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53868 - RNA, 296 nt, synthetic construct
  source 1..296: mol_type = other RNA
cgctcttccgcgtctcgtcttcatgaacgagaaggaggacatcctgtggtgcactgaaatggaaagggccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53869 - RNA, 296 nt, synthetic construct
  source 1..296: mol_type = other RNA
cgctcttccgcgtctcgtcttcatgaacgagaaggaggacatcctgtggtgcactgaaatggaaagggtggcctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53870 - RNA, 296 nt, synthetic construct
  source 1..296: mol_type = other RNA
cgctcttccgcgtctcgtcttcatgaacgagaaggaggacatcctgtggtgcactgaaatggaaagggtgtttgccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53871 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcgccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53872 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcgcccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53873 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53874 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcgcccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53875 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacgcctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53876 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacgccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53877 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53878 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53879 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtggcctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53880 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccgccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53881 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacgccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53882 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatggccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53883 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcgcccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53884 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53885 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53886 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcggccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53887 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgagggcccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53888 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaggccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53889 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagagccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53890 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactggccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53891 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctggccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53892 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcgcccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53893 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgggcctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53894 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcggcctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53895 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53896 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53897 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53898 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53899 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcgccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53900 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcgcccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53901 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcgcccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53902 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacgccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53903 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53904 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53905 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctgccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53906 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccggccctgaaggaatattttgcttgtgtgtctagcggcaatagtaacgctaacagccgcgggccgagcttcagcagcggcctggtgccgttaagcttgcgcgagacgtcggaagagc

SEQ ID NO: 53907 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggccaaggaatattttgcttgtgtgtctagcggcaatagtaacgctaacagccgcgggccgagcttcagcagcggcctggtgccgttaagcttgcgcgagacgtcggaagagc

SEQ ID NO: 53908 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggccgaatattttgcttgtgtgtctagcggcaatagtaacgctaacagccgcgggccgagcttcagcagcggcctggtgccgttaagcttgcgcgagacgtcggaagagc

SEQ ID NO: 53909 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaagcctattttgcttgtgtgtctagcggcaatagtaacgctaacagccgcgggccgagcttcagcagcggcctggtgccgttaagcttgcgcgagacgtcggaagagc

SEQ ID NO: 53910 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgcctttgcttgtgtgtctagcggcaatagtaacgctaacagccgcgggccgagcttcagcagcggcctggtgccgttaagcttgcgcgagacgtcggaagagc

SEQ ID NO: 53911 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgccgcttgtgtgtctagcggcaatagtaacgctaacagccgcgggccgagcttcagcagcggcctggtgccgttaagcttgcgcgagacgtcggaagagc

SEQ ID NO: 53912 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgcctgtgtgtctagcggcaatagtaacgctaacagccgcgggccgagcttcagcagcggcctggtgccgttaagcttgcgcgagacgtcggaagagc

SEQ ID NO: 53913 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgccgtgtctagcggcaatagtaacgctaacagccgcgggccgagcttcagcagcggcctggtgccgttaagcttgcgcgagacgtcggaagagc

SEQ ID NO: 53914 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtggcctctagcggcaatagtaacgctaacagccgcgggccgagcttcagcagcggcctggtgccgttaagcttgcgcgagacgtcggaagagc

SEQ ID NO: 53915 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctgccagcggcaatagtaacgctaacagccgcgggccgagcttcagcagcggcctggtgccgttaagcttgcgcgagacgtcggaagagc

SEQ ID NO: 53916 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcgccggcaatagtaacgctaacagccgcgggccgagcttcagcagcggcctggtgccgttaagcttgcgcgagacgtcggaagagc

SEQ ID NO: 53917 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcgccaatagtaacgctaacagccgcgggccgagcttcagcagcggcctggtgccgttaagcttgcgcgagacgtcggaagagc

SEQ ID NO: 53918 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatgccagtaacgctaacagccgcgggccgagcttcagcagcggcctggtgccgttaagcttgcgcgagacgtcggaagagc

SEQ ID NO: 53919 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgccaacgctaacagccgcgggccgagcttcagcagcggcctggtgccgttaagcttgcgcgagacgtcggaagagc

SEQ ID NO: 53920 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgccgctaacagccgcgggccgagcttcagcagcggcctggtgccgttaagcttgcgcgagacgtcggaagagc

SEQ ID NO: 53921 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctgccaacagccgcgggccgagcttcagcagcggcctggtgccgttaagcttgcgcgagacgtcggaagagc

SEQ ID NO: 53922 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacgccagccgcgggccgagcttcagcagcggcctggtgccgttaagcttgcgcgagacgtcggaagagc

SEQ ID NO: 53923 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgcccgcgggccgagcttcagcagcggcctggtgccgttaagcttgcgcgagacgtcggaagagc

SEQ ID NO: 53924 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgccgggccgagcttcagcagcggcctggtgccgttaagcttgcgcgagacgtcggaagagc

SEQ ID NO: 53925 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcggggccccgagcttcagcagcggcctggtgccgttaagcttgcgcgagacgtcggaagagc

SEQ ID NO: 53926 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccggccagcttcagcagcggcctggtgccgttaagcttgcgcgagacgtcggaagagc

SEQ ID NO: 53927 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcgccttcagcagcggcctggtgccgttaagcttgcgcgagacgtcggaagagc

SEQ ID NO: 53928 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcgccagcagcggcctggtgccgttaagcttgcgcgagacgtcggaagagc

SEQ ID NO: 53929 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcgccagcggcctggtgccgttaagcttgcgcgagacgtcggaagagc

SEQ ID NO: 53930 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcgccggcctggtgccgttaagcttgcgcgagacgtcggaagagc

SEQ ID NO: 53931 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgccctggtgccgttaagcttgcgcgagacgtcggaagagc

SEQ ID NO: 53932 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggccgtgccgttaagcttgcgcgagacgtcggaagagc

SEQ ID NO: 53933 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtggccccgttaagcttgcgcgagacgtcggaagagc

SEQ ID NO: 53934 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccggccttaagcttgcgcgagacgtcggaagagc

SEQ ID NO: 53935 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttagccagcttgcgcgagacgtcggaagagc

SEQ ID NO: 53936 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcgccttgcgcgagacgtcggaagagc

SEQ ID NO: 53937 - RNA, 296 nt, synthetic construct
  source 1..296: mol_type = other RNA
cgctcttccgcgtctcgtcttcatgcagaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53938 - RNA, 296 nt, synthetic construct
  source 1..296: mol_type = other RNA
cgctcttccgcgtctcgtcttcatgaaccaggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53939 - RNA, 296 nt, synthetic construct
  source 1..296: mol_type = other RNA
cgctcttccgcgtctcgtcttcatgaacgagcagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53940 - RNA, 296 nt, synthetic construct
  source 1..296: mol_type = other RNA
cgctcttccgcgtctcgtcttcatgaacgagaagcaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53941 - RNA, 296 nt, synthetic construct
  source 1..296: mol_type = other RNA
cgctcttccgcgtctcgtcttcatgaacgagaaggagcaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53942 - RNA, 296 nt, synthetic construct
  source 1..296: mol_type = other RNA
cgctcttccgcgtctcgtcttcatgaacgagaaggaggaccagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53943 - RNA, 296 nt, synthetic construct
  source 1..296: mol_type = other RNA
cgctcttccgcgtctcgtcttcatgaacgagaaggaggacatccagctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53944 - RNA, 296 nt, synthetic construct
  source 1..296: mol_type = other RNA
cgctcttccgcgtctcgtcttcatgaacgagaaggaggacatcctgcagtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53945 - RNA, 296 nt, synthetic construct
  source 1..296: mol_type = other RNA
cgctcttccgcgtctcgtcttcatgaacgagaaggaggacatcctgtggcagtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53946 - RNA, 296 nt, synthetic construct
  source 1..296: mol_type = other RNA
cgctcttccgcgtctcgtcttcatgaacgagaaggaggacatcctgtggtgccagactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53947 - RNA, 296 nt, synthetic construct
  source 1..296: mol_type = other RNA
cgctcttccgcgtctcgtcttcatgaacgagaaggaggacatcctgtggtgcactcaggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53948 - RNA, 296 nt, synthetic construct
  source 1..296: mol_type = other RNA
cgctcttccgcgtctcgtcttcatgaacgagaaggaggacatcctgtggtgcactgaacagatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53949 - RNA, 296 nt, synthetic construct
  source 1..296: mol_type = other RNA
cgctcttccgcgtctcgtcttcatgaacgagaaggaggacatcctgtggtgcactgaaatgcaggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53950 - RNA, 296 nt, synthetic construct
  source 1..296: mol_type = other RNA
cgctcttccgcgtctcgtcttcatgaacgagaaggaggacatcctgtggtgcactgaaatggaacagagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53951 - RNA, 296 nt, synthetic construct
  source 1..296: mol_type = other RNA
cgctcttccgcgtctcgtcttcatgaacgagaaggaggacatcctgtggtgcactgaaatggaaaggcaggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53952 - RNA, 296 nt, synthetic construct
  source 1..296: mol_type = other RNA
cgctcttccgcgtctcgtcttcatgaacgagaaggaggacatcctgtggtgcactgaaatggaaagggtgcagtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53953 - RNA, 296 nt, synthetic construct
  source 1..296: mol_type = other RNA
cgctcttccgcgtctcgtcttcatgaacgagaaggaggacatcctgtggtgcactgaaatggaaagggtgtttcagggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53954 - RNA, 296 nt, synthetic construct
  source 1..296: mol_type = other RNA
cgctcttccgcgtctcgtcttcatgaacgagaaggaggacatcctgtggtgcactgaaatggaaagggtgtttggccagttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53955 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccagcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53956 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccccaggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53957 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccagcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53958 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccaccagtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53959 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactaccagacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53960 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacacaggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53961 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagaccaggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53962 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgcagtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53963 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcccagaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53964 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaaccagatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53965 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgcagagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53966 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccagcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53967 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgccagttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53968 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcaggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53969 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcagaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53970 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53971 - RNA, 296 nt, synthetic construct; identical to SEQ ID NO: 53970
  source 1..296: mol_type = other RNA

SEQ ID NO: 53972 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53973 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcagctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53974 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcagggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53975 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccagcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53976 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcagtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53977 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcagtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53978 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcagagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53979 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccaggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53980 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcagccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53981 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcaggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53982 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccagatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53983 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccagcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53984 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccagcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53985 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccagctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53986 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccagttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53987 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccaggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53988 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcagccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 53989 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcagctgaaggaatattttgcttgtgtgtctagcggcaatagtaacgctaacagccgcgggccgagcttcagcagcggcctggtgccgttaagcttgcgcgagacgtcggaagagc

SEQ ID NO: 53990 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcagaaggaatattttgcttgtgtgtctagcggcaatagtaacgctaacagccgcgggccgagcttcagcagcggcctggtgccgttaagcttgcgcgagacgtcggaagagc

SEQ ID NO: 53991 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcaggaatattttgcttgtgtgtctagcggcaatagtaacgctaacagccgcgggccgagcttcagcagcggcctggtgccgttaagcttgcgcgagacgtcggaagagc

SEQ ID NO: 53992 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacagtattttgcttgtgtgtctagcggcaatagtaacgctaacagccgcgggccgagcttcagcagcggcctggtgccgttaagcttgcgcgagacgtcggaagagc

SEQ ID NO: 53993 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcagtttgcttgtgtgtctagcggcaatagtaacgctaacagccgcgggccgagcttcagcagcggcctggtgccgttaagcttgcgcgagacgtcggaagagc

SEQ ID NO: 53994 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcaggcttgtgtgtctagcggcaatagtaacgctaacagccgcgggccgagcttcagcagcggcctggtgccgttaagcttgcgcgagacgtcggaagagc

SEQ ID NO: 53995 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcagtgtgtgtctagcggcaatagtaacgctaacagccgcgggccgagcttcagcagcggcctggtgccgttaagcttgcgcgagacgtcggaagagc

SEQ ID NO: 53996 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcaggtgtctagcggcaatagtaacgctaacagccgcgggccgagcttcagcagcggcctggtgccgttaagcttgcgcgagacgtcggaagagc

SEQ ID NO: 53997 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcagtctagcggcaatagtaacgctaacagccgcgggccgagcttcagcagcggcctggtgccgttaagcttgcgcgagacgtcggaagagc

SEQ ID NO: 53998 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcagagcggcaatagtaacgctaacagccgcgggccgagcttcagcagcggcctggtgccgttaagcttgcgcgagacgtcggaagagc

SEQ ID NO: 53999 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccagggcaatagtaacgctaacagccgcgggccgagcttcagcagcggcctggtgccgttaagcttgcgcgagacgtcggaagagc

SEQ ID NO: 54000 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccagaatagtaacgctaacagccgcgggccgagcttcagcagcggcctggtgccgttaagcttgcgcgagacgtcggaagagc

SEQ ID NO: 54001 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcagagtaacgctaacagccgcgggccgagcttcagcagcggcctggtgccgttaagcttgcgcgagacgtcggaagagc

SEQ ID NO: 54002 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcagaacgctaacagccgcgggccgagcttcagcagcggcctggtgccgttaagcttgcgcgagacgtcggaagagc

SEQ ID NO: 54003 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccaggctaacagccgcgggccgagcttcagcagcggcctggtgccgttaagcttgcgcgagacgtcggaagagc

SEQ ID NO: 54004 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcagaacagccgcgggccgagcttcagcagcggcctggtgccgttaagcttgcgcgagacgtcggaagagc

SEQ ID NO: 54005 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccagagccgcgggccgagcttcagcagcggcctggtgccgttaagcttgcgcgagacgtcggaagagc

SEQ ID NO: 54006 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccagcgcgggccgagcttcagcagcggcctggtgccgttaagcttgcgcgagacgtcggaagagc

SEQ ID NO: 54007 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccaggggccgagcttcagcagcggcctggtgccgttaagcttgcgcgagacgtcggaagagc

SEQ ID NO: 54008 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcagccgagcttcagcagcggcctggtgccgttaagcttgcgcgagacgtcggaagagc

SEQ ID NO: 54009 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcagagcttcagcagcggcctggtgccgttaagcttgcgcgagacgtcggaagagc

SEQ ID NO: 54010 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccagttcagcagcggcctggtgccgttaagcttgcgcgagacgtcggaagagc

SEQ ID NO: 54011 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccagagcagcggcctggtgccgttaagcttgcgcgagacgtcggaagagc

SEQ ID NO: 54012 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccagagcggcctggtgccgttaagcttgcgcgagacgtcggaagagc

SEQ ID NO: 54013 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccagggcctggtgccgttaagcttgcgcgagacgtcggaagagc

SEQ ID NO: 54014 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccagctggtgccgttaagcttgcgcgagacgtcggaagagc

SEQ ID NO: 54015 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcaggtgccgttaagcttgcgcgagacgtcggaagagc

SEQ ID NO: 54016 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcagccgttaagcttgcgcgagacgtcggaagagc

SEQ ID NO: 54017 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcagttaagcttgcgcgagacgtcggaagagc

SEQ ID NO: 54018 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacagagcttgcgcgagacgtcggaagagc

SEQ ID NO: 54019 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagccagttgcgcgagacgtcggaagagc

SEQ ID NO: 54020 - RNA, 296 nt, synthetic construct
  source 1..296: mol_type = other RNA
cgctcttccgcgtctcgtcttcatgcacaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54021 - RNA, 296 nt, synthetic construct
  source 1..296: mol_type = other RNA
cgctcttccgcgtctcgtcttcatgaaccacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54022 - RNA, 296 nt, synthetic construct
  source 1..296: mol_type = other RNA
cgctcttccgcgtctcgtcttcatgaacgagcacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54023 - RNA, 296 nt, synthetic construct
  source 1..296: mol_type = other RNA
cgctcttccgcgtctcgtcttcatgaacgagaagcacgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54024 - RNA, 296 nt, synthetic construct
  source 1..296: mol_type = other RNA
cgctcttccgcgtctcgtcttcatgaacgagaaggagcacgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54025 - RNA, 296 nt, synthetic construct
  source 1..296: mol_type = other RNA
cgctcttccgcgtctcgtcttcatgaacgagaaggaggaccacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54026 - RNA, 296 nt, synthetic construct
  source 1..296: mol_type = other RNA
cgctcttccgcgtctcgtcttcatgaacgagaaggaggacatccacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54027 - RNA, 296 nt, synthetic construct
  source 1..296: mol_type = other RNA
cgctcttccgcgtctcgtcttcatgaacgagaaggaggacatcctgcactggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54028 - RNA, 296 nt, synthetic construct
  source 1..296: mol_type = other RNA
cgctcttccgcgtctcgtcttcatgaacgagaaggaggacatcctgtggcactgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54029 - RNA, 296 nt, synthetic construct
  source 1..296: mol_type = other RNA
cgctcttccgcgtctcgtcttcatgaacgagaaggaggacatcctgtggtgccacactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54030 - RNA, 296 nt, synthetic construct
  source 1..296: mol_type = other RNA
cgctcttccgcgtctcgtcttcatgaacgagaaggaggacatcctgtggtgcactcacgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54031 - RNA, 296 nt, synthetic construct
  source 1..296: mol_type = other RNA
cgctcttccgcgtctcgtcttcatgaacgagaaggaggacatcctgtggtgcactgaacacatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54032 - RNA, 296 nt, synthetic construct
  source 1..296: mol_type = other RNA
cgctcttccgcgtctcgtcttcatgaacgagaaggaggacatcctgtggtgcactgaaatgcacgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54033 - RNA, 296 nt, synthetic construct
  source 1..296: mol_type = other RNA
cgctcttccgcgtctcgtcttcatgaacgagaaggaggacatcctgtggtgcactgaaatggaacacagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54034 - RNA, 296 nt, synthetic construct
  source 1..296: mol_type = other RNA
cgctcttccgcgtctcgtcttcatgaacgagaaggaggacatcctgtggtgcactgaaatggaaaggcacgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54035 - RNA, 296 nt, synthetic construct
  source 1..296: mol_type = other RNA
cgctcttccgcgtctcgtcttcatgaacgagaaggaggacatcctgtggtgcactgaaatggaaagggtgcactttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54036 - RNA, 296 nt, synthetic construct
  source 1..296: mol_type = other RNA
cgctcttccgcgtctcgtcttcatgaacgagaaggaggacatcctgtggtgcactgaaatggaaagggtgtttcacggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54037 - RNA, 296 nt, synthetic construct
  source 1..296: mol_type = other RNA
cgctcttccgcgtctcgtcttcatgaacgagaaggaggacatcctgtggtgcactgaaatggaaagggtgtttggccacttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54038 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccaccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54039 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccccacgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54040 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccaccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54041 - RNA, 296 nt, synthetic construct; identical to SEQ ID NO: 54040
  source 1..296: mol_type = other RNA

SEQ ID NO: 54042 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactaccacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54043 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacacacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54044 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagaccacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54045 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgcactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54046 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcccacaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54047 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaaccacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54048 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgcacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54049 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccaccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54050 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgccacttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54051 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcacgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54052 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcacaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54053 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcaccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54054 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcacagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54055 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacacctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54056 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcacctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54057 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcacggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54058 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccaccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54059 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcactcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54060 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcactggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54061 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcacagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54062 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccacgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54063 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcacccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54064 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcacgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54065 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccacatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54066 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccaccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54067 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54068 - RNA, 296 nt, synthetic construct; identical to SEQ ID NO: 54067
  source 1..296: mol_type = other RNA

SEQ ID NO: 54069 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54070 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccacgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54071 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcacccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54072 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcacctgaaggaatattttgcttgtgtgtctagcggcaatagtaacgctaacagccgcgggccgagcttcagcagcggcctggtgccgttaagcttgcgcgagacgtcggaagagc

SEQ ID NO: 54073 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcacaaggaatattttgcttgtgtgtctagcggcaatagtaacgctaacagccgcgggccgagcttcagcagcggcctggtgccgttaagcttgcgcgagacgtcggaagagc

SEQ ID NO: 54074 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcacgaatattttgcttgtgtgtctagcggcaatagtaacgctaacagccgcgggccgagcttcagcagcggcctggtgccgttaagcttgcgcgagacgtcggaagagc

SEQ ID NO: 54075 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacactattttgcttgtgtgtctagcggcaatagtaacgctaacagccgcgggccgagcttcagcagcggcctggtgccgttaagcttgcgcgagacgtcggaagagc

SEQ ID NO: 54076 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcactttgcttgtgtgtctagcggcaatagtaacgctaacagccgcgggccgagcttcagcagcggcctggtgccgttaagcttgcgcgagacgtcggaagagc

SEQ ID NO: 54077 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcacgcttgtgtgtctagcggcaatagtaacgctaacagccgcgggccgagcttcagcagcggcctggtgccgttaagcttgcgcgagacgtcggaagagc

SEQ ID NO: 54078 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcactgtgtgtctagcggcaatagtaacgctaacagccgcgggccgagcttcagcagcggcctggtgccgttaagcttgcgcgagacgtcggaagagc

SEQ ID NO: 54079 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcacgtgtctagcggcaatagtaacgctaacagccgcgggccgagcttcagcagcggcctggtgccgttaagcttgcgcgagacgtcggaagagc

SEQ ID NO: 54080 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcactctagcggcaatagtaacgctaacagccgcgggccgagcttcagcagcggcctggtgccgttaagcttgcgcgagacgtcggaagagc

SEQ ID NO: 54081 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcacagcggcaatagtaacgctaacagccgcgggccgagcttcagcagcggcctggtgccgttaagcttgcgcgagacgtcggaagagc

SEQ ID NO: 54082 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccacggcaatagtaacgctaacagccgcgggccgagcttcagcagcggcctggtgccgttaagcttgcgcgagacgtcggaagagc

SEQ ID NO: 54083 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccacaatagtaacgctaacagccgcgggccgagcttcagcagcggcctggtgccgttaagcttgcgcgagacgtcggaagagc

SEQ ID NO: 54084 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcacagtaacgctaacagccgcgggccgagcttcagcagcggcctggtgccgttaagcttgcgcgagacgtcggaagagc

SEQ ID NO: 54085 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcacaacgctaacagccgcgggccgagcttcagcagcggcctggtgccgttaagcttgcgcgagacgtcggaagagc

SEQ ID NO: 54086 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccacgctaacagccgcgggccgagcttcagcagcggcctggtgccgttaagcttgcgcgagacgtcggaagagc

SEQ ID NO: 54087 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcacaacagccgcgggccgagcttcagcagcggcctggtgccgttaagcttgcgcgagacgtcggaagagc

SEQ ID NO: 54088 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccacagccgcgggccgagcttcagcagcggcctggtgccgttaagcttgcgcgagacgtcggaagagc

SEQ ID NO: 54089 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccaccgcgggccgagcttcagcagcggcctggtgccgttaagcttgcgcgagacgtcggaagagc

SEQ ID NO: 54090 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccacgggccgagcttcagcagcggcctggtgccgttaagcttgcgcgagacgtcggaagagc

SEQ ID NO: 54091 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcacccgagcttcagcagcggcctggtgccgttaagcttgcgcgagacgtcggaagagc

SEQ ID NO: 54092 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcacagcttcagcagcggcctggtgccgttaagcttgcgcgagacgtcggaagagc

SEQ ID NO: 54093 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccacttcagcagcggcctggtgccgttaagcttgcgcgagacgtcggaagagc

SEQ ID NO: 54094 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccacagcagcggcctggtgccgttaagcttgcgcgagacgtcggaagagc

SEQ ID NO: 54095 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccacagcggcctggtgccgttaagcttgcgcgagacgtcggaagagc

SEQ ID NO: 54096 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccacggcctggtgccgttaagcttgcgcgagacgtcggaagagc

SEQ ID NO: 54097 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccacctggtgccgttaagcttgcgcgagacgtcggaagagc

SEQ ID NO: 54098 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcacgtgccgttaagcttgcgcgagacgtcggaagagc

SEQ ID NO: 54099 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcacccgttaagcttgcgcgagacgtcggaagagc

SEQ ID NO: 54100 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcacttaagcttgcgcgagacgtcggaagagc

SEQ ID NO: 54101 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacacagcttgcgcgagacgtcggaagagc

SEQ ID NO: 54102 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagccacttgcgcgagacgtcggaagagc

SEQ ID NO: 54103 - RNA, 296 nt, synthetic construct
  source 1..296: mol_type = other RNA
cgctcttccgcgtctcgtcttcatgctgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54104 - RNA, 296 nt, synthetic construct
  source 1..296: mol_type = other RNA
cgctcttccgcgtctcgtcttcatgaacctggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54105 - RNA, 296 nt, synthetic construct
  source 1..296: mol_type = other RNA
cgctcttccgcgtctcgtcttcatgaacgagctgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54106 - RNA, 296 nt, synthetic construct
  source 1..296: mol_type = other RNA
cgctcttccgcgtctcgtcttcatgaacgagaagctggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54107 - RNA, 296 nt, synthetic construct
  source 1..296: mol_type = other RNA
cgctcttccgcgtctcgtcttcatgaacgagaaggagctggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54108 - RNA, 296 nt, synthetic construct
  source 1..296: mol_type = other RNA
cgctcttccgcgtctcgtcttcatgaacgagaaggaggacctgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54109 - RNA, 296 nt, synthetic construct
  source 1..296: mol_type = other RNA
cgctcttccgcgtctcgtcttcatgaacgagaaggaggacatcctgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54110 - RNA, 296 nt, synthetic construct; identical to SEQ ID NO: 54109
  source 1..296: mol_type = other RNA

SEQ ID NO: 54111 - RNA, 296 nt, synthetic construct
  source 1..296: mol_type = other RNA
cgctcttccgcgtctcgtcttcatgaacgagaaggaggacatcctgtggctgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54112 - RNA, 296 nt, synthetic construct
  source 1..296: mol_type = other RNA
cgctcttccgcgtctcgtcttcatgaacgagaaggaggacatcctgtggtgcctgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54113 - RNA, 296 nt, synthetic construct
  source 1..296: mol_type = other RNA
cgctcttccgcgtctcgtcttcatgaacgagaaggaggacatcctgtggtgcactctggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54114 - RNA, 296 nt, synthetic construct
  source 1..296: mol_type = other RNA
cgctcttccgcgtctcgtcttcatgaacgagaaggaggacatcctgtggtgcactgaactgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54115 - RNA, 296 nt, synthetic construct
  source 1..296: mol_type = other RNA
cgctcttccgcgtctcgtcttcatgaacgagaaggaggacatcctgtggtgcactgaaatgctggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54116 - RNA, 296 nt, synthetic construct
  source 1..296: mol_type = other RNA
cgctcttccgcgtctcgtcttcatgaacgagaaggaggacatcctgtggtgcactgaaatggaactgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54117 - RNA, 296 nt, synthetic construct
  source 1..296: mol_type = other RNA
cgctcttccgcgtctcgtcttcatgaacgagaaggaggacatcctgtggtgcactgaaatggaaaggctggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54118 - RNA, 296 nt, synthetic construct
  source 1..296: mol_type = other RNA
cgctcttccgcgtctcgtcttcatgaacgagaaggaggacatcctgtggtgcactgaaatggaaagggtgctgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54119 - RNA, 296 nt, synthetic construct
  source 1..296: mol_type = other RNA
cgctcttccgcgtctcgtcttcatgaacgagaaggaggacatcctgtggtgcactgaaatggaaagggtgtttctgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54120 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcctgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54121 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcctgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54122 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccctggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54123 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcctgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54124 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacctgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54125 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacctgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54126 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacactggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54127 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacctggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54128 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgctgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54129 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccctgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54130 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacctgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54131 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgctgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54132 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcctgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54133 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcctgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54134 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgctggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54135 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgctgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54136 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggctgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54137 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagctgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54138 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54139 - RNA, 296 nt, synthetic construct; identical to SEQ ID NO: 54138
  source 1..296: mol_type = other RNA

SEQ ID NO: 54140 - RNA, 296 nt, synthetic construct; identical to SEQ ID NO: 54138
  source 1..296: mol_type = other RNA

SEQ ID NO: 54141 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcctgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54142 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggctgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54143 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgctgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54144 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggctgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54145 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcctggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54146 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgctgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54147 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgctggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54148 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcctgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54149 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcctgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54150 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcctgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54151 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54152 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcctgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54153 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcctggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54154 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctctgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54155 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54156 - RNA, 296 nt, synthetic construct; identical to SEQ ID NO: 54155
  source 1..296: mol_type = other RNA

SEQ ID NO: 54157 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagctggaatattttgcttgtgtgtctagcggcaatagtaacgctaacagccgcgggccgagcttcagcagcggcctggtgccgttaagcttgcgcgagacgtcggaagagc

SEQ ID NO: 54158 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaactgtattttgcttgtgtgtctagcggcaatagtaacgctaacagccgcgggccgagcttcagcagcggcctggtgccgttaagcttgcgcgagacgtcggaagagc

SEQ ID NO: 54159 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatctgtttgcttgtgtgtctagcggcaatagtaacgctaacagccgcgggccgagcttcagcagcggcctggtgccgttaagcttgcgcgagacgtcggaagagc

SEQ ID NO: 54160 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttctggcttgtgtgtctagcggcaatagtaacgctaacagccgcgggccgagcttcagcagcggcctggtgccgttaagcttgcgcgagacgtcggaagagc

SEQ ID NO: 54161 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctctgtgtgtgtctagcggcaatagtaacgctaacagccgcgggccgagcttcagcagcggcctggtgccgttaagcttgcgcgagacgtcggaagagc

SEQ ID NO: 54162 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtctggtgtctagcggcaatagtaacgctaacagccgcgggccgagcttcagcagcggcctggtgccgttaagcttgcgcgagacgtcggaagagc

SEQ ID NO: 54163 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgctgtctagcggcaatagtaacgctaacagccgcgggccgagcttcagcagcggcctggtgccgttaagcttgcgcgagacgtcggaagagc

SEQ ID NO: 54164 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctctgagcggcaatagtaacgctaacagccgcgggccgagcttcagcagcggcctggtgccgttaagcttgcgcgagacgtcggaagagc

SEQ ID NO: 54165 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcctgggcaatagtaacgctaacagccgcgggccgagcttcagcagcggcctggtgccgttaagcttgcgcgagacgtcggaagagc

SEQ ID NO: 54166 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcctgaatagtaacgctaacagccgcgggccgagcttcagcagcggcctggtgccgttaagcttgcgcgagacgtcggaagagc

SEQ ID NO: 54167 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatctgagtaacgctaacagccgcgggccgagcttcagcagcggcctggtgccgttaagcttgcgcgagacgtcggaagagc

SEQ ID NO: 54168 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtctgaacgctaacagccgcgggccgagcttcagcagcggcctggtgccgttaagcttgcgcgagacgtcggaagagc

SEQ ID NO: 54169 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacctggctaacagccgcgggccgagcttcagcagcggcctggtgccgttaagcttgcgcgagacgtcggaagagc

SEQ ID NO: 54170 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctctgaacagccgcgggccgagcttcagcagcggcctggtgccgttaagcttgcgcgagacgtcggaagagc

SEQ ID NO: 54171 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacctgagccgcgggccgagcttcagcagcggcctggtgccgttaagcttgcgcgagacgtcggaagagc

SEQ ID NO: 54172 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcctgcgcgggccgagcttcagcagcggcctggtgccgttaagcttgcgcgagacgtcggaagagc

SEQ ID NO: 54173 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcctggggccgagcttcagcagcggcctggtgccgttaagcttgcgcgagacgtcggaagagc

SEQ ID NO: 54174 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggctgccgagcttcagcagcggcctggtgccgttaagcttgcgcgagacgtcggaagagc

SEQ ID NO: 54175 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgctgagcttcagcagcggcctggtgccgttaagcttgcgcgagacgtcggaagagc

SEQ ID NO: 54176 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcctgttcagcagcggcctggtgccgttaagcttgcgcgagacgtcggaagagc

SEQ ID NO: 54177 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcctgagcagcggcctggtgccgttaagcttgcgcgagacgtcggaagagc

SEQ ID NO: 54178 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcctgagcggcctggtgccgttaagcttgcgcgagacgtcggaagagc

SEQ ID NO: 54179 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcctgggcctggtgccgttaagcttgcgcgagacgtcggaagagc

SEQ ID NO: 54180 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgctggtgccgttaagcttgcgcgagacgtcggaagagc

SEQ ID NO: 54181 - RNA, 296 nt, synthetic construct; identical to SEQ ID NO: 54180
  source 1..296: mol_type = other RNA

SEQ ID NO: 54182 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgctgccgttaagcttgcgcgagacgtcggaagagc

SEQ ID NO: 54183 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgctgttaagcttgcgcgagacgtcggaagagc

SEQ ID NO: 54184 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttactgagcttgcgcgagacgtcggaagagc

SEQ ID NO: 54185 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcctgttgcgcgagacgtcggaagagc

SEQ ID NO: 54186 - RNA, 296 nt, synthetic construct
  source 1..296: mol_type = other RNA
cgctcttccgcgtctcgtcttcatgctcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54187 - RNA, 296 nt, synthetic construct
  source 1..296: mol_type = other RNA
cgctcttccgcgtctcgtcttcatgaacctcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54188 - RNA, 296 nt, synthetic construct
  source 1..296: mol_type = other RNA
cgctcttccgcgtctcgtcttcatgaacgagctcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54189 - RNA, 296 nt, synthetic construct
  source 1..296: mol_type = other RNA
cgctcttccgcgtctcgtcttcatgaacgagaagctcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54190 - RNA, 296 nt, synthetic construct
  source 1..296: mol_type = other RNA
cgctcttccgcgtctcgtcttcatgaacgagaaggagctcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54191 - RNA, 296 nt, synthetic construct
  source 1..296: mol_type = other RNA
cgctcttccgcgtctcgtcttcatgaacgagaaggaggacctcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54192 - RNA, 296 nt, synthetic construct
  source 1..296: mol_type = other RNA
cgctcttccgcgtctcgtcttcatgaacgagaaggaggacatcctcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54193 - RNA, 296 nt, synthetic construct
  source 1..296: mol_type = other RNA
cgctcttccgcgtctcgtcttcatgaacgagaaggaggacatcctgctctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54194 - RNA, 296 nt, synthetic construct
  source 1..296: mol_type = other RNA
cgctcttccgcgtctcgtcttcatgaacgagaaggaggacatcctgtggctctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54195 - RNA, 296 nt, synthetic construct
  source 1..296: mol_type = other RNA
cgctcttccgcgtctcgtcttcatgaacgagaaggaggacatcctgtggtgcctcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54196 - RNA, 296 nt, synthetic construct
  source 1..296: mol_type = other RNA
cgctcttccgcgtctcgtcttcatgaacgagaaggaggacatcctgtggtgcactctcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54197 - RNA, 296 nt, synthetic construct
  source 1..296: mol_type = other RNA
cgctcttccgcgtctcgtcttcatgaacgagaaggaggacatcctgtggtgcactgaactcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54198 - RNA, 296 nt, synthetic construct
  source 1..296: mol_type = other RNA
cgctcttccgcgtctcgtcttcatgaacgagaaggaggacatcctgtggtgcactgaaatgctcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54199 - RNA, 296 nt, synthetic construct
  source 1..296: mol_type = other RNA
cgctcttccgcgtctcgtcttcatgaacgagaaggaggacatcctgtggtgcactgaaatggaactcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54200 - RNA, 296 nt, synthetic construct
  source 1..296: mol_type = other RNA
cgctcttccgcgtctcgtcttcatgaacgagaaggaggacatcctgtggtgcactgaaatggaaaggctcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54201 - RNA, 296 nt, synthetic construct
  source 1..296: mol_type = other RNA
cgctcttccgcgtctcgtcttcatgaacgagaaggaggacatcctgtggtgcactgaaatggaaagggtgctctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54202 - RNA, 296 nt, synthetic construct
  source 1..296: mol_type = other RNA
cgctcttccgcgtctcgtcttcatgaacgagaaggaggacatcctgtggtgcactgaaatggaaagggtgtttctcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54203 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcctcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54204 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcctccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54205 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccctcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54206 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcctccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54207 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacctctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54208 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacctcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54209 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacactcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54210 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacctcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54211 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgctctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54212 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccctcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54213 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacctcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54214 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgctcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54215 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcctccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54216 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcctcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54217 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgctcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54218 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgctcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54219 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggctccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54220 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagctcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54221 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54222 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54223 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgctcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54224 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcctccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54225 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggctctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54226 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgctctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54227 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggctcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54228 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcctcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54229 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgctcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54230 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgctcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54231 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcctcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54232 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcctccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54233 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcctccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54234 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54235 - RNA, 296 nt, synthetic construct; identical to SEQ ID NO: 54234
  source 1..296: mol_type = other RNA

SEQ ID NO: 54236 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcctcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54237 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctctcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54238 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctcctgaaggaatattttgcttgtgtgtctagcggcaatagtaacgctaacagccgcgggccgagcttcagcagcggcctggtgccgttaagcttgcgcgagacgtcggaagagc

SEQ ID NO: 54239 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgctcaaggaatattttgcttgtgtgtctagcggcaatagtaacgctaacagccgcgggccgagcttcagcagcggcctggtgccgttaagcttgcgcgagacgtcggaagagc

SEQ ID NO: 54240 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagctcgaatattttgcttgtgtgtctagcggcaatagtaacgctaacagccgcgggccgagcttcagcagcggcctggtgccgttaagcttgcgcgagacgtcggaagagc

SEQ ID NO: 54241 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaactctattttgcttgtgtgtctagcggcaatagtaacgctaacagccgcgggccgagcttcagcagcggcctggtgccgttaagcttgcgcgagacgtcggaagagc

SEQ ID NO: 54242 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatctctttgcttgtgtgtctagcggcaatagtaacgctaacagccgcgggccgagcttcagcagcggcctggtgccgttaagcttgcgcgagacgtcggaagagc

SEQ ID NO: 54243 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttctcgcttgtgtgtctagcggcaatagtaacgctaacagccgcgggccgagcttcagcagcggcctggtgccgttaagcttgcgcgagacgtcggaagagc

SEQ ID NO: 54244 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctctctgtgtgtctagcggcaatagtaacgctaacagccgcgggccgagcttcagcagcggcctggtgccgttaagcttgcgcgagacgtcggaagagc

SEQ ID NO: 54245 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtctcgtgtctagcggcaatagtaacgctaacagccgcgggccgagcttcagcagcggcctggtgccgttaagcttgcgcgagacgtcggaagagc

SEQ ID NO: 54246 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgctctctagcggcaatagtaacgctaacagccgcgggccgagcttcagcagcggcctggtgccgttaagcttgcgcgagacgtcggaagagc

SEQ ID NO: 54247 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctctcagcggcaatagtaacgctaacagccgcgggccgagcttcagcagcggcctggtgccgttaagcttgcgcgagacgtcggaagagc

SEQ ID NO: 54248 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcctcggcaatagtaacgctaacagccgcgggccgagcttcagcagcggcctggtgccgttaagcttgcgcgagacgtcggaagagc

SEQ ID NO: 54249 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcctcaatagtaacgctaacagccgcgggccgagcttcagcagcggcctggtgccgttaagcttgcgcgagacgtcggaagagc

SEQ ID NO: 54250 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatctcagtaacgctaacagccgcgggccgagcttcagcagcggcctggtgccgttaagcttgcgcgagacgtcggaagagc

SEQ ID NO: 54251 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtctcaacgctaacagccgcgggccgagcttcagcagcggcctggtgccgttaagcttgcgcgagacgtcggaagagc

SEQ ID NO: 54252 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacctcgctaacagccgcgggccgagcttcagcagcggcctggtgccgttaagcttgcgcgagacgtcggaagagc

SEQ ID NO: 54253 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctctcaacagccgcgggccgagcttcagcagcggcctggtgccgttaagcttgcgcgagacgtcggaagagc

SEQ ID NO: 54254 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacctcagccgcgggccgagcttcagcagcggcctggtgccgttaagcttgcgcgagacgtcggaagagc

SEQ ID NO: 54255 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcctccgcgggccgagcttcagcagcggcctggtgccgttaagcttgcgcgagacgtcggaagagc

SEQ ID NO: 54256 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcctcgggccgagcttcagcagcggcctggtgccgttaagcttgcgcgagacgtcggaagagc

SEQ ID NO: 54257 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggctcccgagcttcagcagcggcctggtgccgttaagcttgcgcgagacgtcggaagagc

SEQ ID NO: 54258 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgctcagcttcagcagcggcctggtgccgttaagcttgcgcgagacgtcggaagagc

SEQ ID NO: 54259 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcctcttcagcagcggcctggtgccgttaagcttgcgcgagacgtcggaagagc

SEQ ID NO: 54260 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcctcagcagcggcctggtgccgttaagcttgcgcgagacgtcggaagagc

SEQ ID NO: 54261 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcctcagcggcctggtgccgttaagcttgcgcgagacgtcggaagagc

SEQ ID NO: 54262 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcctcggcctggtgccgttaagcttgcgcgagacgtcggaagagc

SEQ ID NO: 54263 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctcctggtgccgttaagcttgcgcgagacgtcggaagagc

SEQ ID NO: 54264 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgctcgtgccgttaagcttgcgcgagacgtcggaagagc

SEQ ID NO: 54265 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgctcccgttaagcttgcgcgagacgtcggaagagc

SEQ ID NO: 54266 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgctcttaagcttgcgcgagacgtcggaagagc

SEQ ID NO: 54267 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttactcagcttgcgcgagacgtcggaagagc

SEQ ID NO: 54268 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcctcttgcgcgagacgtcggaagagc

SEQ ID NO: 54269 - RNA, 296 nt, synthetic construct
  source 1..296: mol_type = other RNA
cgctcttccgcgtctcgtcttcatgcggaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54270 - RNA, 296 nt, synthetic construct
  source 1..296: mol_type = other RNA
cgctcttccgcgtctcgtcttcatgaaccgggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54271 - RNA, 296 nt, synthetic construct
  source 1..296: mol_type = other RNA
cgctcttccgcgtctcgtcttcatgaacgagcggaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54272 - RNA, 296 nt, synthetic construct
  source 1..296: mol_type = other RNA
cgctcttccgcgtctcgtcttcatgaacgagaagcgggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54273 - RNA, 296 nt, synthetic construct
  source 1..296: mol_type = other RNA
cgctcttccgcgtctcgtcttcatgaacgagaaggagcgggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54274 - RNA, 296 nt, synthetic construct
  source 1..296: mol_type = other RNA
cgctcttccgcgtctcgtcttcatgaacgagaaggaggaccggatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54275 - RNA, 296 nt, synthetic construct
  source 1..296: mol_type = other RNA
cgctcttccgcgtctcgtcttcatgaacgagaaggaggacatccggctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54276 - RNA, 296 nt, synthetic construct
  source 1..296: mol_type = other RNA
cgctcttccgcgtctcgtcttcatgaacgagaaggaggacatcctgcggtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54277 - RNA, 296 nt, synthetic construct
  source 1..296: mol_type = other RNA
cgctcttccgcgtctcgtcttcatgaacgagaaggaggacatcctgtggcggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54278 - RNA, 296 nt, synthetic construct
  source 1..296: mol_type = other RNA
cgctcttccgcgtctcgtcttcatgaacgagaaggaggacatcctgtggtgccggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54279 - RNA, 296 nt, synthetic construct
  source 1..296: mol_type = other RNA
cgctcttccgcgtctcgtcttcatgaacgagaaggaggacatcctgtggtgcactcgggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54280 - RNA, 296 nt, synthetic construct
  source 1..296: mol_type = other RNA
cgctcttccgcgtctcgtcttcatgaacgagaaggaggacatcctgtggtgcactgaacggatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54281 - RNA, 296 nt, synthetic construct
  source 1..296: mol_type = other RNA
cgctcttccgcgtctcgtcttcatgaacgagaaggaggacatcctgtggtgcactgaaatgcgggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54282 - RNA, 296 nt, synthetic construct
  source 1..296: mol_type = other RNA
cgctcttccgcgtctcgtcttcatgaacgagaaggaggacatcctgtggtgcactgaaatggaacggagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54283 - RNA, 296 nt, synthetic construct
  source 1..296: mol_type = other RNA
cgctcttccgcgtctcgtcttcatgaacgagaaggaggacatcctgtggtgcactgaaatggaaaggcgggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54284 - RNA, 296 nt, synthetic construct
  source 1..296: mol_type = other RNA
cgctcttccgcgtctcgtcttcatgaacgagaaggaggacatcctgtggtgcactgaaatggaaagggtgcggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54285 - RNA, 296 nt, synthetic construct
  source 1..296: mol_type = other RNA
cgctcttccgcgtctcgtcttcatgaacgagaaggaggacatcctgtggtgcactgaaatggaaagggtgtttcggggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54286 - RNA, 296 nt, synthetic construct
  source 1..296: mol_type = other RNA
cgctcttccgcgtctcgtcttcatgaacgagaaggaggacatcctgtggtgcactgaaatggaaagggtgtttggccggttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54287 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccggcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54288 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccccgggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54289 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccggcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54290 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccaccggtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54291 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactaccggacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54292 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacacgggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54293 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagaccgggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54294 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgcggtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54295 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcccggaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54296 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaaccggatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54297 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgcggagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54298 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccggcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54299 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgccggttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54300 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcgggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54301 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcggaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54302 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54303 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54304 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacggctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54305 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcggctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54306 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcggggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54307 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54308 - RNA, 296 nt, synthetic construct; identical to SEQ ID NO: 54307
  source 1..296: mol_type = other RNA

SEQ ID NO: 54309 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54310 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54311 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccgggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54312 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcggccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54313 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcgggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54314 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccggatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54315 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccggcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54316 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccggcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54317 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccggctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54318 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccggttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54319 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccgggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54320 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcggccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54321 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcggctgaaggaatattttgcttgtgtgtctagcggcaatagtaacgctaacagccgcgggccgagcttcagcagcggcctggtgccgttaagcttgcgcgagacgtcggaagagc

SEQ ID NO: 54322 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcggaaggaatattttgcttgtgtgtctagcggcaatagtaacgctaacagccgcgggccgagcttcagcagcggcctggtgccgttaagcttgcgcgagacgtcggaagagc

SEQ ID NO: 54323 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcgggaatattttgcttgtgtgtctagcggcaatagtaacgctaacagccgcgggccgagcttcagcagcggcctggtgccgttaagcttgcgcgagacgtcggaagagc

SEQ ID NO: 54324 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacggtattttgcttgtgtgtctagcggcaatagtaacgctaacagccgcgggccgagcttcagcagcggcctggtgccgttaagcttgcgcgagacgtcggaagagc

SEQ ID NO: 54325 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcggtttgcttgtgtgtctagcggcaatagtaacgctaacagccgcgggccgagcttcagcagcggcctggtgccgttaagcttgcgcgagacgtcggaagagc

SEQ ID NO: 54326 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcgggcttgtgtgtctagcggcaatagtaacgctaacagccgcgggccgagcttcagcagcggcctggtgccgttaagcttgcgcgagacgtcggaagagc

SEQ ID NO: 54327 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcggtgtgtgtctagcggcaatagtaacgctaacagccgcgggccgagcttcagcagcggcctggtgccgttaagcttgcgcgagacgtcggaagagc

SEQ ID NO: 54328 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcgggtgtctagcggcaatagtaacgctaacagccgcgggccgagcttcagcagcggcctggtgccgttaagcttgcgcgagacgtcggaagagc

SEQ ID NO: 54329 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcggtctagcggcaatagtaacgctaacagccgcgggccgagcttcagcagcggcctggtgccgttaagcttgcgcgagacgtcggaagagc

SEQ ID NO: 54330 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcggagcggcaatagtaacgctaacagccgcgggccgagcttcagcagcggcctggtgccgttaagcttgcgcgagacgtcggaagagc

SEQ ID NO: 54331 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccggggcaatagtaacgctaacagccgcgggccgagcttcagcagcggcctggtgccgttaagcttgcgcgagacgtcggaagagc

SEQ ID NO: 54332 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccggaatagtaacgctaacagccgcgggccgagcttcagcagcggcctggtgccgttaagcttgcgcgagacgtcggaagagc

SEQ ID NO: 54333 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcggagtaacgctaacagccgcgggccgagcttcagcagcggcctggtgccgttaagcttgcgcgagacgtcggaagagc

SEQ ID NO: 54334 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcggaacgctaacagccgcgggccgagcttcagcagcggcctggtgccgttaagcttgcgcgagacgtcggaagagc

SEQ ID NO: 54335 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccgggctaacagccgcgggccgagcttcagcagcggcctggtgccgttaagcttgcgcgagacgtcggaagagc

SEQ ID NO: 54336 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcggaacagccgcgggccgagcttcagcagcggcctggtgccgttaagcttgcgcgagacgtcggaagagc

SEQ ID NO: 54337 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccggagccgcgggccgagcttcagcagcggcctggtgccgttaagcttgcgcgagacgtcggaagagc

SEQ ID NO: 54338 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccggcgcgggccgagcttcagcagcggcctggtgccgttaagcttgcgcgagacgtcggaagagc

SEQ ID NO: 54339 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccgggggccgagcttcagcagcggcctggtgccgttaagcttgcgcgagacgtcggaagagc

SEQ ID NO: 54340 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcggccgagcttcagcagcggcctggtgccgttaagcttgcgcgagacgtcggaagagc

SEQ ID NO: 54341 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcggagcttcagcagcggcctggtgccgttaagcttgcgcgagacgtcggaagagc

SEQ ID NO: 54342 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccggttcagcagcggcctggtgccgttaagcttgcgcgagacgtcggaagagc

SEQ ID NO: 54343 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccggagcagcggcctggtgccgttaagcttgcgcgagacgtcggaagagc

SEQ ID NO: 54344 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccggagcggcctggtgccgttaagcttgcgcgagacgtcggaagagc

SEQ ID NO: 54345 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccggggcctggtgccgttaagcttgcgcgagacgtcggaagagc

SEQ ID NO: 54346 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccggctggtgccgttaagcttgcgcgagacgtcggaagagc

SEQ ID NO: 54347 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcgggtgccgttaagcttgcgcgagacgtcggaagagc

SEQ ID NO: 54348 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcggccgttaagcttgcgcgagacgtcggaagagc

SEQ ID NO: 54349 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcggttaagcttgcgcgagacgtcggaagagc

SEQ ID NO: 54350 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacggagcttgcgcgagacgtcggaagagc

SEQ ID NO: 54351 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagccggttgcgcgagacgtcggaagagc

SEQ ID NO: 54352 - RNA, 296 nt, synthetic construct
  source 1..296: mol_type = other RNA
cgctcttccgcgtctcgtcttcatgcgcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54353 - RNA, 296 nt, synthetic construct
  source 1..296: mol_type = other RNA
cgctcttccgcgtctcgtcttcatgaaccgcgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54354 - RNA, 296 nt, synthetic construct
  source 1..296: mol_type = other RNA
cgctcttccgcgtctcgtcttcatgaacgagcgcaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54355 - RNA, 296 nt, synthetic construct
  source 1..296: mol_type = other RNA
cgctcttccgcgtctcgtcttcatgaacgagaagcgcgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54356 - RNA, 296 nt, synthetic construct
  source 1..296: mol_type = other RNA
cgctcttccgcgtctcgtcttcatgaacgagaaggagcgcgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54357 - RNA, 296 nt, synthetic construct
  source 1..296: mol_type = other RNA
cgctcttccgcgtctcgtcttcatgaacgagaaggaggaccgcatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54358 - RNA, 296 nt, synthetic construct
  source 1..296: mol_type = other RNA
cgctcttccgcgtctcgtcttcatgaacgagaaggaggacatccgcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54359 - RNA, 296 nt, synthetic construct
  source 1..296: mol_type = other RNA
cgctcttccgcgtctcgtcttcatgaacgagaaggaggacatcctgcgctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54360 - RNA, 296 nt, synthetic construct
  source 1..296: mol_type = other RNA
cgctcttccgcgtctcgtcttcatgaacgagaaggaggacatcctgtggcgctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54361 - RNA, 296 nt, synthetic construct
  source 1..296: mol_type = other RNA
cgctcttccgcgtctcgtcttcatgaacgagaaggaggacatcctgtggtgccgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54362 - RNA, 296 nt, synthetic construct
  source 1..296: mol_type = other RNA
cgctcttccgcgtctcgtcttcatgaacgagaaggaggacatcctgtggtgcactcgcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54363 - RNA, 296 nt, synthetic construct
  source 1..296: mol_type = other RNA
cgctcttccgcgtctcgtcttcatgaacgagaaggaggacatcctgtggtgcactgaacgcatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54364 - RNA, 296 nt, synthetic construct
  source 1..296: mol_type = other RNA
cgctcttccgcgtctcgtcttcatgaacgagaaggaggacatcctgtggtgcactgaaatgcgcgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54365 - RNA, 296 nt, synthetic construct
  source 1..296: mol_type = other RNA
cgctcttccgcgtctcgtcttcatgaacgagaaggaggacatcctgtggtgcactgaaatggaacgcagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54366 - RNA, 296 nt, synthetic construct
  source 1..296: mol_type = other RNA
cgctcttccgcgtctcgtcttcatgaacgagaaggaggacatcctgtggtgcactgaaatggaaaggcgcgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54367 - RNA, 296 nt, synthetic construct
  source 1..296: mol_type = other RNA
cgctcttccgcgtctcgtcttcatgaacgagaaggaggacatcctgtggtgcactgaaatggaaagggtgcgctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54368 - RNA, 296 nt, synthetic construct
  source 1..296: mol_type = other RNA
cgctcttccgcgtctcgtcttcatgaacgagaaggaggacatcctgtggtgcactgaaatggaaagggtgtttcgcggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54369 - RNA, 296 nt, synthetic construct
  source 1..296: mol_type = other RNA
cgctcttccgcgtctcgtcttcatgaacgagaaggaggacatcctgtggtgcactgaaatggaaagggtgtttggccgcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54370 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccgccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54371 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccccgcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54372 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccgccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54373 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccaccgctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54374 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactaccgcacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54375 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacacgcgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54376 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagaccgcgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54377 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgcgctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54378 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcccgcaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54379 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaaccgcatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54380 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgcgcagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54381 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54382 - RNA, 296 nt, synthetic construct; identical to SEQ ID NO: 54381
  source 1..296: mol_type = other RNA

SEQ ID NO: 54383 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcgcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54384 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcgcaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54385 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcgccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54386 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcgcagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54387 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacgcctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54388 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcgcctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54389 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcgcggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54390 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccgccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54391 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggcgctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54392 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgcgctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54393 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcgcagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54394 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccgcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54395 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcgcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54396 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcgcgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54397 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccgcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54398 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54399 - RNA, 296 nt, synthetic construct; identical to SEQ ID NO: 54398
  source 1..296: mol_type = other RNA

SEQ ID NO: 54400 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccgcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54401 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccgcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54402 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccgcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54403 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcgcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54404 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcgcctgaaggaatattttgcttgtgtgtctagcggcaatagtaacgctaacagccgcgggccgagcttcagcagcggcctggtgccgttaagcttgcgcgagacgtcggaagagc

SEQ ID NO: 54405 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcgcaaggaatattttgcttgtgtgtctagcggcaatagtaacgctaacagccgcgggccgagcttcagcagcggcctggtgccgttaagcttgcgcgagacgtcggaagagc

SEQ ID NO: 54406 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcgcgaatattttgcttgtgtgtctagcggcaatagtaacgctaacagccgcgggccgagcttcagcagcggcctggtgccgttaagcttgcgcgagacgtcggaagagc

SEQ ID NO: 54407 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaacgctattttgcttgtgtgtctagcggcaatagtaacgctaacagccgcgggccgagcttcagcagcggcctggtgccgttaagcttgcgcgagacgtcggaagagc

SEQ ID NO: 54408 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatcgctttgcttgtgtgtctagcggcaatagtaacgctaacagccgcgggccgagcttcagcagcggcctggtgccgttaagcttgcgcgagacgtcggaagagc

SEQ ID NO: 54409 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcgcgcttgtgtgtctagcggcaatagtaacgctaacagccgcgggccgagcttcagcagcggcctggtgccgttaagcttgcgcgagacgtcggaagagc

SEQ ID NO: 54410 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctcgctgtgtgtctagcggcaatagtaacgctaacagccgcgggccgagcttcagcagcggcctggtgccgttaagcttgcgcgagacgtcggaagagc

SEQ ID NO: 54411 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcgcgtgtctagcggcaatagtaacgctaacagccgcgggccgagcttcagcagcggcctggtgccgttaagcttgcgcgagacgtcggaagagc

SEQ ID NO: 54412 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgcgctctagcggcaatagtaacgctaacagccgcgggccgagcttcagcagcggcctggtgccgttaagcttgcgcgagacgtcggaagagc

SEQ ID NO: 54413 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcgcagcggcaatagtaacgctaacagccgcgggccgagcttcagcagcggcctggtgccgttaagcttgcgcgagacgtcggaagagc

SEQ ID NO: 54414 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccgcggcaatagtaacgctaacagccgcgggccgagcttcagcagcggcctggtgccgttaagcttgcgcgagacgtcggaagagc

SEQ ID NO: 54415 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccgcaatagtaacgctaacagccgcgggccgagcttcagcagcggcctggtgccgttaagcttgcgcgagacgtcggaagagc

SEQ ID NO: 54416 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcgcagtaacgctaacagccgcgggccgagcttcagcagcggcctggtgccgttaagcttgcgcgagacgtcggaagagc

SEQ ID NO: 54417 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcgcaacgctaacagccgcgggccgagcttcagcagcggcctggtgccgttaagcttgcgcgagacgtcggaagagc

SEQ ID NO: 54418 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccgcgctaacagccgcgggccgagcttcagcagcggcctggtgccgttaagcttgcgcgagacgtcggaagagc

SEQ ID NO: 54419 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcgcaacagccgcgggccgagcttcagcagcggcctggtgccgttaagcttgcgcgagacgtcggaagagc

SEQ ID NO: 54420 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccgcagccgcgggccgagcttcagcagcggcctggtgccgttaagcttgcgcgagacgtcggaagagc

SEQ ID NO: 54421 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccgcgggccgagcttcagcagcggcctggtgccgttaagcttgcgcgagacgtcggaagagc

SEQ ID NO: 54422 - RNA, 296 nt, synthetic construct; identical to SEQ ID NO: 54421
  source 1..296: mol_type = other RNA

SEQ ID NO: 54423 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcgcccgagcttcagcagcggcctggtgccgttaagcttgcgcgagacgtcggaagagc

SEQ ID NO: 54424 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcgcagcttcagcagcggcctggtgccgttaagcttgcgcgagacgtcggaagagc

SEQ ID NO: 54425 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccgcttcagcagcggcctggtgccgttaagcttgcgcgagacgtcggaagagc

SEQ ID NO: 54426 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccgcagcagcggcctggtgccgttaagcttgcgcgagacgtcggaagagc

SEQ ID NO: 54427 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccgcagcggcctggtgccgttaagcttgcgcgagacgtcggaagagc

SEQ ID NO: 54428 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccgcggcctggtgccgttaagcttgcgcgagacgtcggaagagc

SEQ ID NO: 54429 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccgcctggtgccgttaagcttgcgcgagacgtcggaagagc

SEQ ID NO: 54430 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcgcgtgccgttaagcttgcgcgagacgtcggaagagc

SEQ ID NO: 54431 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcgcccgttaagcttgcgcgagacgtcggaagagc

SEQ ID NO: 54432 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcgcttaagcttgcgcgagacgtcggaagagc

SEQ ID NO: 54433 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacgcagcttgcgcgagacgtcggaagagc

SEQ ID NO: 54434 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagccgcttgcgcgagacgtcggaagagc

SEQ ID NO: 54435 - RNA, 296 nt, synthetic construct
  source 1..296: mol_type = other RNA
cgctcttccgcgtctcgtcttcatgccgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54436 - RNA, 296 nt, synthetic construct
  source 1..296: mol_type = other RNA
cgctcttccgcgtctcgtcttcatgaacccggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54437 - RNA, 296 nt, synthetic construct
  source 1..296: mol_type = other RNA
cgctcttccgcgtctcgtcttcatgaacgagccgaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54438 - RNA, 296 nt, synthetic construct
  source 1..296: mol_type = other RNA
cgctcttccgcgtctcgtcttcatgaacgagaagccggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54439 - RNA, 296 nt, synthetic construct
  source 1..296: mol_type = other RNA
cgctcttccgcgtctcgtcttcatgaacgagaaggagccggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54440 - RNA, 296 nt, synthetic construct
  source 1..296: mol_type = other RNA
cgctcttccgcgtctcgtcttcatgaacgagaaggaggacccgatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54441 - RNA, 296 nt, synthetic construct
  source 1..296: mol_type = other RNA
cgctcttccgcgtctcgtcttcatgaacgagaaggaggacatcccgctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54442 - RNA, 296 nt, synthetic construct
  source 1..296: mol_type = other RNA
cgctcttccgcgtctcgtcttcatgaacgagaaggaggacatcctgccgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54443 - RNA, 296 nt, synthetic construct
  source 1..296: mol_type = other RNA
cgctcttccgcgtctcgtcttcatgaacgagaaggaggacatcctgtggccgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54444 - RNA, 296 nt, synthetic construct
  source 1..296: mol_type = other RNA
cgctcttccgcgtctcgtcttcatgaacgagaaggaggacatcctgtggtgcccgactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54445 - RNA, 296 nt, synthetic construct
  source 1..296: mol_type = other RNA
cgctcttccgcgtctcgtcttcatgaacgagaaggaggacatcctgtggtgcactccggaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54446 - RNA, 296 nt, synthetic construct
  source 1..296: mol_type = other RNA
cgctcttccgcgtctcgtcttcatgaacgagaaggaggacatcctgtggtgcactgaaccgatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54447 - RNA, 296 nt, synthetic construct
  source 1..296: mol_type = other RNA
cgctcttccgcgtctcgtcttcatgaacgagaaggaggacatcctgtggtgcactgaaatgccggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54448 - RNA, 296 nt, synthetic construct
  source 1..296: mol_type = other RNA
cgctcttccgcgtctcgtcttcatgaacgagaaggaggacatcctgtggtgcactgaaatggaaccgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54449 - RNA, 296 nt, synthetic construct
  source 1..296: mol_type = other RNA
cgctcttccgcgtctcgtcttcatgaacgagaaggaggacatcctgtggtgcactgaaatggaaaggccggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54450 - RNA, 296 nt, synthetic construct
  source 1..296: mol_type = other RNA
cgctcttccgcgtctcgtcttcatgaacgagaaggaggacatcctgtggtgcactgaaatggaaagggtgccgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54451 - RNA, 296 nt, synthetic construct
  source 1..296: mol_type = other RNA
cgctcttccgcgtctcgtcttcatgaacgagaaggaggacatcctgtggtgcactgaaatggaaagggtgtttccgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54452 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcccgttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54453 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccgcccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54454 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccccggtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54455 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcccgcactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54456 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacccgtacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54457 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacccgacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54458 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacaccggacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54459 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacccggtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54460 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgccgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54461 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccccgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54462 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacccgatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54463 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgccgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54464 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcccgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54465 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcccgttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54466 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgccggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54467 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgccgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54468 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggccgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54469 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagccgagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54470 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagaccgctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54471 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgccgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54472 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgccgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54473 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcccgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54474 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggccgtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54475 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgccgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54476 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggccgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54477 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcccggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54478 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54479 - RNA, 296 nt, synthetic construct; identical to SEQ ID NO: 54478
  source 1..296: mol_type = other RNA

SEQ ID NO: 54480 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcccgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54481 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcccgcgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54482 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcccgcacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54483 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacccgctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54484 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcccgttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54485 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcccggctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54486 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54487 - RNA, 296 nt, synthetic construct; identical to SEQ ID NO: 54486
  source 1..296: mol_type = other RNA

SEQ ID NO: 54488 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgccgaaggaatattttgcttgtgtgtctagcggcaatagtaacgctaacagccgcgggccgagcttcagcagcggcctggtgccgttaagcttgcgcgagacgtcggaagagc

SEQ ID NO: 54489 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagccggaatattttgcttgtgtgtctagcggcaatagtaacgctaacagccgcgggccgagcttcagcagcggcctggtgccgttaagcttgcgcgagacgtcggaagagc

SEQ ID NO: 54490 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaccgtattttgcttgtgtgtctagcggcaatagtaacgctaacagccgcgggccgagcttcagcagcggcctggtgccgttaagcttgcgcgagacgtcggaagagc

SEQ ID NO: 54491 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatccgtttgcttgtgtgtctagcggcaatagtaacgctaacagccgcgggccgagcttcagcagcggcctggtgccgttaagcttgcgcgagacgtcggaagagc

SEQ ID NO: 54492 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttccggcttgtgtgtctagcggcaatagtaacgctaacagccgcgggccgagcttcagcagcggcctggtgccgttaagcttgcgcgagacgtcggaagagc

SEQ ID NO: 54493 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctccgtgtgtgtctagcggcaatagtaacgctaacagccgcgggccgagcttcagcagcggcctggtgccgttaagcttgcgcgagacgtcggaagagc

SEQ ID NO: 54494 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtccggtgtctagcggcaatagtaacgctaacagccgcgggccgagcttcagcagcggcctggtgccgttaagcttgcgcgagacgtcggaagagc

SEQ ID NO: 54495 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgccgtctagcggcaatagtaacgctaacagccgcgggccgagcttcagcagcggcctggtgccgttaagcttgcgcgagacgtcggaagagc

SEQ ID NO: 54496 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctccgagcggcaatagtaacgctaacagccgcgggccgagcttcagcagcggcctggtgccgttaagcttgcgcgagacgtcggaagagc

SEQ ID NO: 54497 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcccgggcaatagtaacgctaacagccgcgggccgagcttcagcagcggcctggtgccgttaagcttgcgcgagacgtcggaagagc

SEQ ID NO: 54498 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcccgaatagtaacgctaacagccgcgggccgagcttcagcagcggcctggtgccgttaagcttgcgcgagacgtcggaagagc

SEQ ID NO: 54499 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatccgagtaacgctaacagccgcgggccgagcttcagcagcggcctggtgccgttaagcttgcgcgagacgtcggaagagc

SEQ ID NO: 54500 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtccgaacgctaacagccgcgggccgagcttcagcagcggcctggtgccgttaagcttgcgcgagacgtcggaagagc

SEQ ID NO: 54501 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacccggctaacagccgcgggccgagcttcagcagcggcctggtgccgttaagcttgcgcgagacgtcggaagagc

SEQ ID NO: 54502 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctccgaacagccgcgggccgagcttcagcagcggcctggtgccgttaagcttgcgcgagacgtcggaagagc

SEQ ID NO: 54503 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacccgagccgcgggccgagcttcagcagcggcctggtgccgttaagcttgcgcgagacgtcggaagagc

SEQ ID NO: 54504 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcccgcgcgggccgagcttcagcagcggcctggtgccgttaagcttgcgcgagacgtcggaagagc

SEQ ID NO: 54505 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcccggggccgagcttcagcagcggcctggtgccgttaagcttgcgcgagacgtcggaagagc

SEQ ID NO: 54506 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgccgagcttcagcagcggcctggtgccgttaagcttgcgcgagacgtcggaagagc

SEQ ID NO: 54507 - RNA, 296 nt, synthetic construct; identical to SEQ ID NO: 54506
  source 1..296: mol_type = other RNA

SEQ ID NO: 54508 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcccgttcagcagcggcctggtgccgttaagcttgcgcgagacgtcggaagagc

SEQ ID NO: 54509 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcccgagcagcggcctggtgccgttaagcttgcgcgagacgtcggaagagc

SEQ ID NO: 54510 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcccgagcggcctggtgccgttaagcttgcgcgagacgtcggaagagc

SEQ ID NO: 54511 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcccgggcctggtgccgttaagcttgcgcgagacgtcggaagagc

SEQ ID NO: 54512 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcccgctggtgccgttaagcttgcgcgagacgtcggaagagc

SEQ ID NO: 54513 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgccggtgccgttaagcttgcgcgagacgtcggaagagc

SEQ ID NO: 54514 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgccgttaagcttgcgcgagacgtcggaagagc

SEQ ID NO: 54515 - RNA, 296 nt, synthetic construct; identical to SEQ ID NO: 54514
  source 1..296: mol_type = other RNA

SEQ ID NO: 54516 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaccgagcttgcgcgagacgtcggaagagc

SEQ ID NO: 54517 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcccgttgcgcgagacgtcggaagagc

SEQ ID NO: 54518 - RNA, 296 nt, synthetic construct
  source 1..296: mol_type = other RNA
cgctcttccgcgtctcgtcttcatgcccaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54519 - RNA, 296 nt, synthetic construct
  source 1..296: mol_type = other RNA
cgctcttccgcgtctcgtcttcatgaaccccgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54520 - RNA, 296 nt, synthetic construct
  source 1..296: mol_type = other RNA
cgctcttccgcgtctcgtcttcatgaacgagcccaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54521 - RNA, 296 nt, synthetic construct
  source 1..296: mol_type = other RNA
cgctcttccgcgtctcgtcttcatgaacgagaagcccgaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54522 - RNA, 296 nt, synthetic construct
  source 1..296: mol_type = other RNA
cgctcttccgcgtctcgtcttcatgaacgagaaggagcccgacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54523 - RNA, 296 nt, synthetic construct
  source 1..296: mol_type = other RNA
cgctcttccgcgtctcgtcttcatgaacgagaaggaggaccccatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54524 - RNA, 296 nt, synthetic construct
  source 1..296: mol_type = other RNA
cgctcttccgcgtctcgtcttcatgaacgagaaggaggacatccccctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54525 - RNA, 296 nt, synthetic construct
  source 1..296: mol_type = other RNA
cgctcttccgcgtctcgtcttcatgaacgagaaggaggacatcctgccctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54526 - RNA, 296 nt, synthetic construct
  source 1..296: mol_type = other RNA
cgctcttccgcgtctcgtcttcatgaacgagaaggaggacatcctgtggccctgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54527 - RNA, 296 nt, synthetic construct
  source 1..296: mol_type = other RNA
cgctcttccgcgtctcgtcttcatgaacgagaaggaggacatcctgtggtgccccactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54528 - RNA, 296 nt, synthetic construct
  source 1..296: mol_type = other RNA
cgctcttccgcgtctcgtcttcatgaacgagaaggaggacatcctgtggtgcactcccgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54529 - RNA, 296 nt, synthetic construct
  source 1..296: mol_type = other RNA
cgctcttccgcgtctcgtcttcatgaacgagaaggaggacatcctgtggtgcactgaacccatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54530 - RNA, 296 nt, synthetic construct
  source 1..296: mol_type = other RNA
cgctcttccgcgtctcgtcttcatgaacgagaaggaggacatcctgtggtgcactgaaatgcccgaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54531 - RNA, 296 nt, synthetic construct
  source 1..296: mol_type = other RNA
cgctcttccgcgtctcgtcttcatgaacgagaaggaggacatcctgtggtgcactgaaatggaacccagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54532 - RNA, 296 nt, synthetic construct
  source 1..296: mol_type = other RNA
cgctcttccgcgtctcgtcttcatgaacgagaaggaggacatcctgtggtgcactgaaatggaaaggcccgtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54533 - RNA, 296 nt, synthetic construct
  source 1..296: mol_type = other RNA
cgctcttccgcgtctcgtcttcatgaacgagaaggaggacatcctgtggtgcactgaaatggaaagggtgccctttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54534 - RNA, 296 nt, synthetic construct
  source 1..296: mol_type = other RNA
cgctcttccgcgtctcgtcttcatgaacgagaaggaggacatcctgtggtgcactgaaatggaaagggtgtttcccggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54535 - RNA, 296 nt, synthetic construct
  source 1..296: mol_type = other RNA
cgctcttccgcgtctcgtcttcatgaacgagaaggaggacatcctgtggtgcactgaaatggaaagggtgtttggccccttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54536 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttcccccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54537 - RNA, 296 nt, synthetic construct; identical to SEQ ID NO: 54536
  source 1..296: mol_type = other RNA

SEQ ID NO: 54538 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtcccccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54539 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccacccctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54540 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactaccccacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54541 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacacccgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54542 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagaccccgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54543 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgccctccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54544 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtcccccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54545 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaaccccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54546 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgcccagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54547 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagcccccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54548 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgccccttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54549 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgcccgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54550 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcccaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54551 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggccccagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54552 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagcccagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54553 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagacccctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54554 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgcccctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54555 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcccggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54556 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggcccccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54557 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggccctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54558 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgccctggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54559 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggcccagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54560 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagccccgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54561 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgcccccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54562 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgcccgtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54563 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccccatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54564 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatcccccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54565 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcccccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54566 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccaccccctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54567 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctccccttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54568 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttccccgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54569 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctcccccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54570 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgcccctgaaggaatattttgcttgtgtgtctagcggcaatagtaacgctaacagccgcgggccgagcttcagcagcggcctggtgccgttaagcttgcgcgagacgtcggaagagc

SEQ ID NO: 54571 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgcccaaggaatattttgcttgtgtgtctagcggcaatagtaacgctaacagccgcgggccgagcttcagcagcggcctggtgccgttaagcttgcgcgagacgtcggaagagc

SEQ ID NO: 54572 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagcccgaatattttgcttgtgtgtctagcggcaatagtaacgctaacagccgcgggccgagcttcagcagcggcctggtgccgttaagcttgcgcgagacgtcggaagagc

SEQ ID NO: 54573 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaaccctattttgcttgtgtgtctagcggcaatagtaacgctaacagccgcgggccgagcttcagcagcggcctggtgccgttaagcttgcgcgagacgtcggaagagc

SEQ ID NO: 54574 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatccctttgcttgtgtgtctagcggcaatagtaacgctaacagccgcgggccgagcttcagcagcggcctggtgccgttaagcttgcgcgagacgtcggaagagc

SEQ ID NO: 54575 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttcccgcttgtgtgtctagcggcaatagtaacgctaacagccgcgggccgagcttcagcagcggcctggtgccgttaagcttgcgcgagacgtcggaagagc

SEQ ID NO: 54576 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctccctgtgtgtctagcggcaatagtaacgctaacagccgcgggccgagcttcagcagcggcctggtgccgttaagcttgcgcgagacgtcggaagagc

SEQ ID NO: 54577 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtcccgtgtctagcggcaatagtaacgctaacagccgcgggccgagcttcagcagcggcctggtgccgttaagcttgcgcgagacgtcggaagagc

SEQ ID NO: 54578 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgccctctagcggcaatagtaacgctaacagccgcgggccgagcttcagcagcggcctggtgccgttaagcttgcgcgagacgtcggaagagc

SEQ ID NO: 54579 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctcccagcggcaatagtaacgctaacagccgcgggccgagcttcagcagcggcctggtgccgttaagcttgcgcgagacgtcggaagagc

SEQ ID NO: 54580 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagccccggcaatagtaacgctaacagccgcgggccgagcttcagcagcggcctggtgccgttaagcttgcgcgagacgtcggaagagc

SEQ ID NO: 54581 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggccccaatagtaacgctaacagccgcgggccgagcttcagcagcggcctggtgccgttaagcttgcgcgagacgtcggaagagc

SEQ ID NO: 54582 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatcccagtaacgctaacagccgcgggccgagcttcagcagcggcctggtgccgttaagcttgcgcgagacgtcggaagagc

SEQ ID NO: 54583 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtcccaacgctaacagccgcgggccgagcttcagcagcggcctggtgccgttaagcttgcgcgagacgtcggaagagc

SEQ ID NO: 54584 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaaccccgctaacagccgcgggccgagcttcagcagcggcctggtgccgttaagcttgcgcgagacgtcggaagagc

SEQ ID NO: 54585 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctcccaacagccgcgggccgagcttcagcagcggcctggtgccgttaagcttgcgcgagacgtcggaagagc

SEQ ID NO: 54586 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccccagccgcgggccgagcttcagcagcggcctggtgccgttaagcttgcgcgagacgtcggaagagc

SEQ ID NO: 54587 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcccccgcgggccgagcttcagcagcggcctggtgccgttaagcttgcgcgagacgtcggaagagc

SEQ ID NO: 54588 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgccccgggccgagcttcagcagcggcctggtgccgttaagcttgcgcgagacgtcggaagagc

SEQ ID NO: 54589 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggcccccgagcttcagcagcggcctggtgccgttaagcttgcgcgagacgtcggaagagc

SEQ ID NO: 54590 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgcccagcttcagcagcggcctggtgccgttaagcttgcgcgagacgtcggaagagc

SEQ ID NO: 54591 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagccccttcagcagcggcctggtgccgttaagcttgcgcgagacgtcggaagagc

SEQ ID NO: 54592 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttccccagcagcggcctggtgccgttaagcttgcgcgagacgtcggaagagc

SEQ ID NO: 54593 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagccccagcggcctggtgccgttaagcttgcgcgagacgtcggaagagc

SEQ ID NO: 54594 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagccccggcctggtgccgttaagcttgcgcgagacgtcggaagagc

SEQ ID NO: 54595 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggccccctggtgccgttaagcttgcgcgagacgtcggaagagc

SEQ ID NO: 54596 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgcccgtgccgttaagcttgcgcgagacgtcggaagagc

SEQ ID NO: 54597 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgcccccgttaagcttgcgcgagacgtcggaagagc

SEQ ID NO: 54598 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgcccttaagcttgcgcgagacgtcggaagagc

SEQ ID NO: 54599 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttacccagcttgcgcgagacgtcggaagagc

SEQ ID NO: 54600 - RNA, 296 nt, synthetic construct
  source 1..296: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagccccttgcgcgagacgtcggaagagc

SEQ ID NO: 54601 - RNA, 290 nt, synthetic construct
  source 1..290: mol_type = other RNA
cgctcttccgcgtctcgtcttcaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54602 - RNA, 290 nt, synthetic construct
  source 1..290: mol_type = other RNA
cgctcttccgcgtctcgtcttcatggagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54603 - RNA, 290 nt, synthetic construct
  source 1..290: mol_type = other RNA
cgctcttccgcgtctcgtcttcatgaacaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54604 - RNA, 290 nt, synthetic construct
  source 1..290: mol_type = other RNA
cgctcttccgcgtctcgtcttcatgaacgaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54605 - RNA, 290 nt, synthetic construct
  source 1..290: mol_type = other RNA
cgctcttccgcgtctcgtcttcatgaacgagaaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54606 - RNA, 290 nt, synthetic construct
  source 1..290: mol_type = other RNA
cgctcttccgcgtctcgtcttcatgaacgagaaggagatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54607 - RNA, 290 nt, synthetic construct
  source 1..290: mol_type = other RNA
cgctcttccgcgtctcgtcttcatgaacgagaaggaggacctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54608 - RNA, 290 nt, synthetic construct
  source 1..290: mol_type = other RNA
cgctcttccgcgtctcgtcttcatgaacgagaaggaggacatctggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54609 - RNA, 290 nt, synthetic construct
  source 1..290: mol_type = other RNA
cgctcttccgcgtctcgtcttcatgaacgagaaggaggacatcctgtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54610 - RNA, 290 nt, synthetic construct
  source 1..290: mol_type = other RNA
cgctcttccgcgtctcgtcttcatgaacgagaaggaggacatcctgtggactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54611 - RNA, 290 nt, synthetic construct
  source 1..290: mol_type = other RNA
cgctcttccgcgtctcgtcttcatgaacgagaaggaggacatcctgtggtgcgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54612 - RNA, 290 nt, synthetic construct
  source 1..290: mol_type = other RNA
cgctcttccgcgtctcgtcttcatgaacgagaaggaggacatcctgtggtgcactatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54613 - RNA, 290 nt, synthetic construct
  source 1..290: mol_type = other RNA
cgctcttccgcgtctcgtcttcatgaacgagaaggaggacatcctgtggtgcactgaagaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54614 - RNA, 290 nt, synthetic construct
  source 1..290: mol_type = other RNA
cgctcttccgcgtctcgtcttcatgaacgagaaggaggacatcctgtggtgcactgaaatgagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54615 - RNA, 290 nt, synthetic construct
  source 1..290: mol_type = other RNA
cgctcttccgcgtctcgtcttcatgaacgagaaggaggacatcctgtggtgcactgaaatggaagtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54616 - RNA, 290 nt, synthetic construct
  source 1..290: mol_type = other RNA
cgctcttccgcgtctcgtcttcatgaacgagaaggaggacatcctgtggtgcactgaaatggaaaggtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54617 - RNA, 290 nt, synthetic construct
  source 1..290: mol_type = other RNA
cgctcttccgcgtctcgtcttcatgaacgagaaggaggacatcctgtggtgcactgaaatggaaagggtgggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54618 - RNA, 290 nt, synthetic construct
  source 1..290: mol_type = other RNA
cgctcttccgcgtctcgtcttcatgaacgagaaggaggacatcctgtggtgcactgaaatggaaagggtgtttttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54619 - RNA, 290 nt, synthetic construct
  source 1..290: mol_type = other RNA
cgctcttccgcgtctcgtcttcatgaacgagaaggaggacatcctgtggtgcactgaaatggaaagggtgtttggccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54620 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttcgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54621 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttcccccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54622 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtctacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54623 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54624 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacgacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54625 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54626 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagactccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54627 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54628 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54629 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54630 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgcgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54631 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54632 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcgcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54633 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54634 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54635 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54636 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagctgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54637 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54638 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgcggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54639 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggctcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54640 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54641 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgagcgtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54642 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtgggtgccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54643 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcccggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54644 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtggtcatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54645 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccgatccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54646 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtccgccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54647 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccacctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54648 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgcctcttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54649 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacttcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54650 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcgctccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54651 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcccgctgaaggaatattttgcttgtgtgtctagcggcaatagtaacgctaacagccgcgggccgagcttcagcagcggcctggtgccgttaagcttgcgcgagacgtcggaagagc

SEQ ID NO: 54652 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctctgaaggaatattttgcttgtgtgtctagcggcaatagtaacgctaacagccgcgggccgagcttcagcagcggcctggtgccgttaagcttgcgcgagacgtcggaagagc

SEQ ID NO: 54653 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgaaggaatattttgcttgtgtgtctagcggcaatagtaacgctaacagccgcgggccgagcttcagcagcggcctggtgccgttaagcttgcgcgagacgtcggaagagc

SEQ ID NO: 54654 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctggaatattttgcttgtgtgtctagcggcaatagtaacgctaacagccgcgggccgagcttcagcagcggcctggtgccgttaagcttgcgcgagacgtcggaagagc

SEQ ID NO: 54655 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaagtattttgcttgtgtgtctagcggcaatagtaacgctaacagccgcgggccgagcttcagcagcggcctggtgccgttaagcttgcgcgagacgtcggaagagc

SEQ ID NO: 54656 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatttgcttgtgtgtctagcggcaatagtaacgctaacagccgcgggccgagcttcagcagcggcctggtgccgttaagcttgcgcgagacgtcggaagagc

SEQ ID NO: 54657 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatgcttgtgtgtctagcggcaatagtaacgctaacagccgcgggccgagcttcagcagcggcctggtgccgttaagcttgcgcgagacgtcggaagagc

SEQ ID NO: 54658 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatatttttgtgtgtctagcggcaatagtaacgctaacagccgcgggccgagcttcagcagcggcctggtgccgttaagcttgcgcgagacgtcggaagagc

SEQ ID NO: 54659 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgctgtgtctagcggcaatagtaacgctaacagccgcgggccgagcttcagcagcggcctggtgccgttaagcttgcgcgagacgtcggaagagc

SEQ ID NO: 54660 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgttctagcggcaatagtaacgctaacagccgcgggccgagcttcagcagcggcctggtgccgttaagcttgcgcgagacgtcggaagagc

SEQ ID NO: 54661 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgagcggcaatagtaacgctaacagccgcgggccgagcttcagcagcggcctggtgccgttaagcttgcgcgagacgtcggaagagc

SEQ ID NO: 54662 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctggcaatagtaacgctaacagccgcgggccgagcttcagcagcggcctggtgccgttaagcttgcgcgagacgtcggaagagc

SEQ ID NO: 54663 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcaatagtaacgctaacagccgcgggccgagcttcagcagcggcctggtgccgttaagcttgcgcgagacgtcggaagagc

SEQ ID NO: 54664 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcagtaacgctaacagccgcgggccgagcttcagcagcggcctggtgccgttaagcttgcgcgagacgtcggaagagc

SEQ ID NO: 54665 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaataacgctaacagccgcgggccgagcttcagcagcggcctggtgccgttaagcttgcgcgagacgtcggaagagc

SEQ ID NO: 54666 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtgctaacagccgcgggccgagcttcagcagcggcctggtgccgttaagcttgcgcgagacgtcggaagagc

SEQ ID NO: 54667 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacaacagccgcgggccgagcttcagcagcggcctggtgccgttaagcttgcgcgagacgtcggaagagc

SEQ ID NO: 54668 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctagccgcgggccgagcttcagcagcggcctggtgccgttaagcttgcgcgagacgtcggaagagc

SEQ ID NO: 54669 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaaccgcgggccgagcttcagcagcggcctggtgccgttaagcttgcgcgagacgtcggaagagc

SEQ ID NO: 54670 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagcgggccgagcttcagcagcggcctggtgccgttaagcttgcgcgagacgtcggaagagc

SEQ ID NO: 54671 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcccgagcttcagcagcggcctggtgccgttaagcttgcgcgagacgtcggaagagc

SEQ ID NO: 54672 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggagcttcagcagcggcctggtgccgttaagcttgcgcgagacgtcggaagagc

SEQ ID NO: 54673 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgttcagcagcggcctggtgccgttaagcttgcgcgagacgtcggaagagc

SEQ ID NO: 54674 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcagcagcggcctggtgccgttaagcttgcgcgagacgtcggaagagc

SEQ ID NO: 54675 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcggcctggtgccgttaagcttgcgcgagacgtcggaagagc

SEQ ID NO: 54676 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcctggtgccgttaagcttgcgcgagacgtcggaagagc

SEQ ID NO: 54677 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcgtgccgttaagcttgcgcgagacgtcggaagagc

SEQ ID NO: 54678 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctgccgttaagcttgcgcgagacgtcggaagagc

SEQ ID NO: 54679 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgttaagcttgcgcgagacgtcggaagagc

SEQ ID NO: 54680 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgagcttgcgcgagacgtcggaagagc

SEQ ID NO: 54681 - RNA, 290 nt, synthetic construct
  source 1..290: mol_type = other RNA
cgctcttccgcgtctcgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttattgcgcgagacgtcggaagagc

SEQ ID NO: 54682 - RNA, 293 nt, synthetic construct; identical to SEQ ID NO: 49292
  source 1..293: mol_type = other RNA

SEQ ID NO: 54683 - RNA, 289 nt, synthetic construct
  source 1..289: mol_type = other RNA
cgctcttccgcgtctcttaagcaagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54684 - RNA, 289 nt, synthetic construct
  source 1..289: mol_type = other RNA
cgctcttccgcgtctcttaagcttgaagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54685 - RNA, 289 nt, synthetic construct
  source 1..289: mol_type = other RNA
cgctcttccgcgtctcttaagcttgcgcaagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54686 - RNA, 289 nt, synthetic construct
  source 1..289: mol_type = other RNA
cgctcttccgcgtctcttaagcttgcgcggcaagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54687 - RNA, 289 nt, synthetic construct
  source 1..289: mol_type = other RNA
cgctcttccgcgtctcttaagcttgcgcggcagcaagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54688 - RNA, 289 nt, synthetic construct
  source 1..289: mol_type = other RNA
cgctcttccgcgtctcttaagcttgcgcggcagccataagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54689 - RNA, 289 nt, synthetic construct
  source 1..289: mol_type = other RNA
cgctcttccgcgtctcttaagcttgcgcggcagccatatgaagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54690 - RNA, 289 nt, synthetic construct
  source 1..289: mol_type = other RNA
cgctcttccgcgtctcttaagcttgcgcggcagccatatgggcaagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54691 - RNA, 289 nt, synthetic construct
  source 1..289: mol_type = other RNA
cgctcttccgcgtctcttaagcttgcgcggcagccatatgggccctaaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54692 - RNA, 289 nt, synthetic construct
  source 1..289: mol_type = other RNA
cgctcttccgcgtctcttaagcttgcgcggcagccatatgggccctatgaagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54693 - RNA, 289 nt, synthetic construct
  source 1..289: mol_type = other RNA
cgctcttccgcgtctcttaagcttgcgcggcagccatatgggccctatggagaagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54694 - RNA, 289 nt, synthetic construct
  source 1..289: mol_type = other RNA
cgctcttccgcgtctcttaagcttgcgcggcagccatatgggccctatggagataaagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54695 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54696 - RNA, 289 nt, synthetic construct
  source 1..289: mol_type = other RNA
cgctcttccgcgtctcttaagcttgcgcggcagccatatgggccctatggagatatacaagaaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54697 - RNA, 289 nt, synthetic construct
  source 1..289: mol_type = other RNA
cgctcttccgcgtctcttaagcttgcgcggcagccatatgggccctatggagatatacaagacaaagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54698 - RNA, 289 nt, synthetic construct
  source 1..289: mol_type = other RNA
cgctcttccgcgtctcttaagcttgcgcggcagccatatgggccctatggagatatacaagacagtgaaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54699 - RNA, 289 nt, synthetic construct
  source 1..289: mol_type = other RNA
cgctcttccgcgtctcttaagcttgcgcggcagccatatgggccctatggagatatacaagacagtgtctaagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54700 - RNA, 289 nt, synthetic construct
  source 1..289: mol_type = other RNA
cgctcttccgcgtctcttaagcttgcgcggcagccatatgggccctatggagatatacaagacagtgtctgcaaagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54701 - RNA, 289 nt, synthetic construct; identical to SEQ ID NO: 54695
  source 1..289: mol_type = other RNA

SEQ ID NO: 54702 - RNA, 289 nt, synthetic construct
  source 1..289: mol_type = other RNA
cgctcttccgcgtctcttaagcttgcgcggcagccatatgggccctatggagatatacaagacagtgtctgcatggaagaagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54703 - RNA, 289 nt, synthetic construct
  source 1..289: mol_type = other RNA
cgctcttccgcgtctcttaagcttgcgcggcagccatatgggccctatggagatatacaagacagtgtctgcatggaagagaaagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54704 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagaaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54705 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaaagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54706 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgaaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54707 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggaagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54708 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaaagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54709 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgaagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54710 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcaagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54711 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcaagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54712 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcaagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54713 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54714 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacaaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54715 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcaagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54716 - RNA, 289 nt, synthetic construct; identical to SEQ ID NO: 54695
  source 1..289: mol_type = other RNA

SEQ ID NO: 54717 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54718 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54719 - RNA, 289 nt, synthetic construct; identical to SEQ ID NO: 54695
  source 1..289: mol_type = other RNA

SEQ ID NO: 54720 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54721 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54722 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54723 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54724 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54725 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54726 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54727 - RNA, 289 nt, synthetic construct
  source 1..289: mol_type = other RNA
cgctcttccgcgtctcttaagcaaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54728 - RNA, 289 nt, synthetic construct
  source 1..289: mol_type = other RNA
cgctcttccgcgtctcttaagcttgaacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54729 - RNA, 289 nt, synthetic construct
  source 1..289: mol_type = other RNA
cgctcttccgcgtctcttaagcttgcgcaacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54730 - RNA, 289 nt, synthetic construct
  source 1..289: mol_type = other RNA
cgctcttccgcgtctcttaagcttgcgcggcaaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54731 - RNA, 289 nt, synthetic construct
  source 1..289: mol_type = other RNA
cgctcttccgcgtctcttaagcttgcgcggcagcaacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54732 - RNA, 289 nt, synthetic construct
  source 1..289: mol_type = other RNA
cgctcttccgcgtctcttaagcttgcgcggcagccataacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54733 - RNA, 289 nt, synthetic construct
  source 1..289: mol_type = other RNA
cgctcttccgcgtctcttaagcttgcgcggcagccatatgaaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54734 - RNA, 289 nt, synthetic construct
  source 1..289: mol_type = other RNA
cgctcttccgcgtctcttaagcttgcgcggcagccatatgggcaacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54735 - RNA, 289 nt, synthetic construct
  source 1..289: mol_type = other RNA
cgctcttccgcgtctcttaagcttgcgcggcagccatatgggccctaacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54736 - RNA, 289 nt, synthetic construct
  source 1..289: mol_type = other RNA
cgctcttccgcgtctcttaagcttgcgcggcagccatatgggccctatgaacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54737 - RNA, 289 nt, synthetic construct
  source 1..289: mol_type = other RNA
cgctcttccgcgtctcttaagcttgcgcggcagccatatgggccctatggagaactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54738 - RNA, 289 nt, synthetic construct
  source 1..289: mol_type = other RNA
cgctcttccgcgtctcttaagcttgcgcggcagccatatgggccctatggagataaacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54739 - RNA, 289 nt, synthetic construct
  source 1..289: mol_type = other RNA
cgctcttccgcgtctcttaagcttgcgcggcagccatatgggccctatggagatatacaacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54740 - RNA, 289 nt, synthetic construct
  source 1..289: mol_type = other RNA
cgctcttccgcgtctcttaagcttgcgcggcagccatatgggccctatggagatatacaagaacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54741 - RNA, 289 nt, synthetic construct
  source 1..289: mol_type = other RNA
cgctcttccgcgtctcttaagcttgcgcggcagccatatgggccctatggagatatacaagacaaactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54742 - RNA, 289 nt, synthetic construct
  source 1..289: mol_type = other RNA
cgctcttccgcgtctcttaagcttgcgcggcagccatatgggccctatggagatatacaagacagtgaacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54743 - RNA, 289 nt, synthetic construct
  source 1..289: mol_type = other RNA
cgctcttccgcgtctcttaagcttgcgcggcagccatatgggccctatggagatatacaagacagtgtctaactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54744 - RNA, 289 nt, synthetic construct
  source 1..289: mol_type = other RNA
cgctcttccgcgtctcttaagcttgcgcggcagccatatgggccctatggagatatacaagacagtgtctgcaaacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54745 - RNA, 289 nt, synthetic construct
  source 1..289: mol_type = other RNA
cgctcttccgcgtctcttaagcttgcgcggcagccatatgggccctatggagatatacaagacagtgtctgcatggaacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54746 - RNA, 289 nt, synthetic construct
  source 1..289: mol_type = other RNA
cgctcttccgcgtctcttaagcttgcgcggcagccatatgggccctatggagatatacaagacagtgtctgcatggaagaaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54747 - RNA, 289 nt, synthetic construct
  source 1..289: mol_type = other RNA
cgctcttccgcgtctcttaagcttgcgcggcagccatatgggccctatggagatatacaagacagtgtctgcatggaagagaaacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54748 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagaacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54749 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaaaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54750 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgaacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54751 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggaacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54752 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaaacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54753 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgaacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54754 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcaacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54755 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcaacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54756 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcaacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54757 - RNA, 289 nt, synthetic construct; identical to SEQ ID NO: 54695
  source 1..289: mol_type = other RNA

SEQ ID NO: 54758 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacaacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54759 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcaacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54760 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54761 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54762 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54763 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54764 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54765 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54766 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54767 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54768 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54769 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54770 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54771 - RNA, 289 nt, synthetic construct
  source 1..289: mol_type = other RNA
cgctcttccgcgtctcttaagcatgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54772 - RNA, 289 nt, synthetic construct
  source 1..289: mol_type = other RNA
cgctcttccgcgtctcttaagcttgatgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54773 - RNA, 289 nt, synthetic construct
  source 1..289: mol_type = other RNA
cgctcttccgcgtctcttaagcttgcgcatgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54774 - RNA, 289 nt, synthetic construct
  source 1..289: mol_type = other RNA
cgctcttccgcgtctcttaagcttgcgcggcatgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54775 - RNA, 289 nt, synthetic construct
  source 1..289: mol_type = other RNA
cgctcttccgcgtctcttaagcttgcgcggcagcatgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54776 - RNA, 289 nt, synthetic construct; identical to SEQ ID NO: 54695
  source 1..289: mol_type = other RNA

SEQ ID NO: 54777 - RNA, 289 nt, synthetic construct
  source 1..289: mol_type = other RNA
cgctcttccgcgtctcttaagcttgcgcggcagccatatgatgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54778 - RNA, 289 nt, synthetic construct
  source 1..289: mol_type = other RNA
cgctcttccgcgtctcttaagcttgcgcggcagccatatgggcatgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54779 - RNA, 289 nt, synthetic construct; identical to SEQ ID NO: 54695
  source 1..289: mol_type = other RNA

SEQ ID NO: 54780 - RNA, 289 nt, synthetic construct
  source 1..289: mol_type = other RNA
cgctcttccgcgtctcttaagcttgcgcggcagccatatgggccctatgatgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54781 - RNA, 289 nt, synthetic construct
  source 1..289: mol_type = other RNA
cgctcttccgcgtctcttaagcttgcgcggcagccatatgggccctatggagatgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54782 - RNA, 289 nt, synthetic construct
  source 1..289: mol_type = other RNA
cgctcttccgcgtctcttaagcttgcgcggcagccatatgggccctatggagataatgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54783 - RNA, 289 nt, synthetic construct
  source 1..289: mol_type = other RNA
cgctcttccgcgtctcttaagcttgcgcggcagccatatgggccctatggagatatacatgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54784 - RNA, 289 nt, synthetic construct
  source 1..289: mol_type = other RNA
cgctcttccgcgtctcttaagcttgcgcggcagccatatgggccctatggagatatacaagatggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54785 - RNA, 289 nt, synthetic construct
  source 1..289: mol_type = other RNA
cgctcttccgcgtctcttaagcttgcgcggcagccatatgggccctatggagatatacaagacaatgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54786 - RNA, 289 nt, synthetic construct
  source 1..289: mol_type = other RNA
cgctcttccgcgtctcttaagcttgcgcggcagccatatgggccctatggagatatacaagacagtgatggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54787 - RNA, 289 nt, synthetic construct
  source 1..289: mol_type = other RNA
cgctcttccgcgtctcttaagcttgcgcggcagccatatgggccctatggagatatacaagacagtgtctatgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54788 - RNA, 289 nt, synthetic construct
  source 1..289: mol_type = other RNA
cgctcttccgcgtctcttaagcttgcgcggcagccatatgggccctatggagatatacaagacagtgtctgcaatgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54789 - RNA, 289 nt, synthetic construct
  source 1..289: mol_type = other RNA
cgctcttccgcgtctcttaagcttgcgcggcagccatatgggccctatggagatatacaagacagtgtctgcatggatgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54790 - RNA, 289 nt, synthetic construct
  source 1..289: mol_type = other RNA
cgctcttccgcgtctcttaagcttgcgcggcagccatatgggccctatggagatatacaagacagtgtctgcatggaagatgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54791 - RNA, 289 nt, synthetic construct
  source 1..289: mol_type = other RNA
cgctcttccgcgtctcttaagcttgcgcggcagccatatgggccctatggagatatacaagacagtgtctgcatggaagagaatgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54792 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagatggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54793 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaatgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54794 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgatggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54795 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggatgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54796 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaatgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54797 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgatgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54798 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcatgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54799 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcatgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54800 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcatgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54801 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaatgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54802 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54803 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcatgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54804 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacatggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54805 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagatgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54806 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaatgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54807 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaatgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54808 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagatgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54809 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtatgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54810 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgatgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54811 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcatgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54812 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcatggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54813 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgatgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54814 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaatgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54815 - RNA, 289 nt, synthetic construct
  source 1..289: mol_type = other RNA
cgctcttccgcgtctcttaagcatccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54816 - RNA, 289 nt, synthetic construct
  source 1..289: mol_type = other RNA
cgctcttccgcgtctcttaagcttgatcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54817 - RNA, 289 nt, synthetic construct
  source 1..289: mol_type = other RNA
cgctcttccgcgtctcttaagcttgcgcatcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54818 - RNA, 289 nt, synthetic construct
  source 1..289: mol_type = other RNA
cgctcttccgcgtctcttaagcttgcgcggcatccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54819 - RNA, 289 nt, synthetic construct
  source 1..289: mol_type = other RNA
cgctcttccgcgtctcttaagcttgcgcggcagcatcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54820 - RNA, 289 nt, synthetic construct
  source 1..289: mol_type = other RNA
cgctcttccgcgtctcttaagcttgcgcggcagccatatcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54821 - RNA, 289 nt, synthetic construct
  source 1..289: mol_type = other RNA
cgctcttccgcgtctcttaagcttgcgcggcagccatatgatccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54822 - RNA, 289 nt, synthetic construct
  source 1..289: mol_type = other RNA
cgctcttccgcgtctcttaagcttgcgcggcagccatatgggcatcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54823 - RNA, 289 nt, synthetic construct
  source 1..289: mol_type = other RNA
cgctcttccgcgtctcttaagcttgcgcggcagccatatgggccctatcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54824 - RNA, 289 nt, synthetic construct
  source 1..289: mol_type = other RNA
cgctcttccgcgtctcttaagcttgcgcggcagccatatgggccctatgatcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54825 - RNA, 289 nt, synthetic construct
  source 1..289: mol_type = other RNA
cgctcttccgcgtctcttaagcttgcgcggcagccatatgggccctatggagatctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54826 - RNA, 289 nt, synthetic construct
  source 1..289: mol_type = other RNA
cgctcttccgcgtctcttaagcttgcgcggcagccatatgggccctatggagataatcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54827 - RNA, 289 nt, synthetic construct
  source 1..289: mol_type = other RNA
cgctcttccgcgtctcttaagcttgcgcggcagccatatgggccctatggagatatacatcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54828 - RNA, 289 nt, synthetic construct
  source 1..289: mol_type = other RNA
cgctcttccgcgtctcttaagcttgcgcggcagccatatgggccctatggagatatacaagatcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54829 - RNA, 289 nt, synthetic construct
  source 1..289: mol_type = other RNA
cgctcttccgcgtctcttaagcttgcgcggcagccatatgggccctatggagatatacaagacaatctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54830 - RNA, 289 nt, synthetic construct
  source 1..289: mol_type = other RNA
cgctcttccgcgtctcttaagcttgcgcggcagccatatgggccctatggagatatacaagacagtgatcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54831 - RNA, 289 nt, synthetic construct
  source 1..289: mol_type = other RNA
cgctcttccgcgtctcttaagcttgcgcggcagccatatgggccctatggagatatacaagacagtgtctatctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54832 - RNA, 289 nt, synthetic construct
  source 1..289: mol_type = other RNA
cgctcttccgcgtctcttaagcttgcgcggcagccatatgggccctatggagatatacaagacagtgtctgcaatcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54833 - RNA, 289 nt, synthetic construct
  source 1..289: mol_type = other RNA
cgctcttccgcgtctcttaagcttgcgcggcagccatatgggccctatggagatatacaagacagtgtctgcatggatcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54834 - RNA, 289 nt, synthetic construct
  source 1..289: mol_type = other RNA
cgctcttccgcgtctcttaagcttgcgcggcagccatatgggccctatggagatatacaagacagtgtctgcatggaagatccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54835 - RNA, 289 nt, synthetic construct
  source 1..289: mol_type = other RNA
cgctcttccgcgtctcttaagcttgcgcggcagccatatgggccctatggagatatacaagacagtgtctgcatggaagagaatcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54836 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagatcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54837 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaatccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54838 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgatcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54839 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggatcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54840 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaatcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54841 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgatcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54842 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcatcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54843 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcatcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54844 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcatcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54845 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaatcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54846 - RNA, 289 nt, synthetic construct; identical to SEQ ID NO: 54695
  source 1..289: mol_type = other RNA

SEQ ID NO: 54847 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcatcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54848 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacatcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54849 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagatcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54850 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaatcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54851 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaatcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54852 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagatcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54853 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtatcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54854 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgatcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54855 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcatcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54856 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcatcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54857 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgatcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54858 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaatcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54859 - RNA, 289 nt, synthetic construct
  source 1..289: mol_type = other RNA
cgctcttccgcgtctcttaagcaggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54860 - RNA, 289 nt, synthetic construct
  source 1..289: mol_type = other RNA
cgctcttccgcgtctcttaagcttgaggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54861 - RNA, 289 nt, synthetic construct
  source 1..289: mol_type = other RNA
cgctcttccgcgtctcttaagcttgcgcaggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54862 - RNA, 289 nt, synthetic construct
  source 1..289: mol_type = other RNA
cgctcttccgcgtctcttaagcttgcgcggcaggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54863 - RNA, 289 nt, synthetic construct
  source 1..289: mol_type = other RNA
cgctcttccgcgtctcttaagcttgcgcggcagcaggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54864 - RNA, 289 nt, synthetic construct
  source 1..289: mol_type = other RNA
cgctcttccgcgtctcttaagcttgcgcggcagccataggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54865 - RNA, 289 nt, synthetic construct
  source 1..289: mol_type = other RNA
cgctcttccgcgtctcttaagcttgcgcggcagccatatgaggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54866 - RNA, 289 nt, synthetic construct
  source 1..289: mol_type = other RNA
cgctcttccgcgtctcttaagcttgcgcggcagccatatgggcaggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54867 - RNA, 289 nt, synthetic construct
  source 1..289: mol_type = other RNA
cgctcttccgcgtctcttaagcttgcgcggcagccatatgggccctagggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54868 - RNA, 289 nt, synthetic construct
  source 1..289: mol_type = other RNA
cgctcttccgcgtctcttaagcttgcgcggcagccatatgggccctatgaggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54869 - RNA, 289 nt, synthetic construct
  source 1..289: mol_type = other RNA
cgctcttccgcgtctcttaagcttgcgcggcagccatatgggccctatggagaggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54870 - RNA, 289 nt, synthetic construct
  source 1..289: mol_type = other RNA
cgctcttccgcgtctcttaagcttgcgcggcagccatatgggccctatggagataaggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54871 - RNA, 289 nt, synthetic construct
  source 1..289: mol_type = other RNA
cgctcttccgcgtctcttaagcttgcgcggcagccatatgggccctatggagatatacaggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54872 - RNA, 289 nt, synthetic construct
  source 1..289: mol_type = other RNA
cgctcttccgcgtctcttaagcttgcgcggcagccatatgggccctatggagatatacaagagggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54873 - RNA, 289 nt, synthetic construct
  source 1..289: mol_type = other RNA
cgctcttccgcgtctcttaagcttgcgcggcagccatatgggccctatggagatatacaagacaaggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54874 - RNA, 289 nt, synthetic construct
  source 1..289: mol_type = other RNA
cgctcttccgcgtctcttaagcttgcgcggcagccatatgggccctatggagatatacaagacagtgagggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54875 - RNA, 289 nt, synthetic construct
  source 1..289: mol_type = other RNA
cgctcttccgcgtctcttaagcttgcgcggcagccatatgggccctatggagatatacaagacagtgtctaggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54876 - RNA, 289 nt, synthetic construct
  source 1..289: mol_type = other RNA
cgctcttccgcgtctcttaagcttgcgcggcagccatatgggccctatggagatatacaagacagtgtctgcaaggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54877 - RNA, 289 nt, synthetic construct
  source 1..289: mol_type = other RNA
cgctcttccgcgtctcttaagcttgcgcggcagccatatgggccctatggagatatacaagacagtgtctgcatggaggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54878 - RNA, 289 nt, synthetic construct
  source 1..289: mol_type = other RNA
cgctcttccgcgtctcttaagcttgcgcggcagccatatgggccctatggagatatacaagacagtgtctgcatggaagaggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54879 - RNA, 289 nt, synthetic construct
  source 1..289: mol_type = other RNA
cgctcttccgcgtctcttaagcttgcgcggcagccatatgggccctatggagatatacaagacagtgtctgcatggaagagaaggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54880 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagagggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54881 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaaggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54882 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgagggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54883 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggaggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54884 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaaggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54885 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgaggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54886 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcaggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54887 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcaggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54888 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcaggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54889 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54890 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacagggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54891 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcaggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54892 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacagggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54893 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54894 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54895 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54896 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54897 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54898 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54899 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54900 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcagggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54901 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54902 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54903 - RNA, 289 nt, synthetic construct
  source 1..289: mol_type = other RNA
cgctcttccgcgtctcttaagcagccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54904 - RNA, 289 nt, synthetic construct
  source 1..289: mol_type = other RNA
cgctcttccgcgtctcttaagcttgagcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54905 - RNA, 289 nt, synthetic construct
  source 1..289: mol_type = other RNA
cgctcttccgcgtctcttaagcttgcgcagcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54906 - RNA, 289 nt, synthetic construct; identical to SEQ ID NO: 54695
  source 1..289: mol_type = other RNA

SEQ ID NO: 54907 - RNA, 289 nt, synthetic construct
  source 1..289: mol_type = other RNA
cgctcttccgcgtctcttaagcttgcgcggcagcagcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54908 - RNA, 289 nt, synthetic construct
  source 1..289: mol_type = other RNA
cgctcttccgcgtctcttaagcttgcgcggcagccatagcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54909 - RNA, 289 nt, synthetic construct
  source 1..289: mol_type = other RNA
cgctcttccgcgtctcttaagcttgcgcggcagccatatgagccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54910 - RNA, 289 nt, synthetic construct
  source 1..289: mol_type = other RNA
cgctcttccgcgtctcttaagcttgcgcggcagccatatgggcagcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54911 - RNA, 289 nt, synthetic construct
  source 1..289: mol_type = other RNA
cgctcttccgcgtctcttaagcttgcgcggcagccatatgggccctagcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54912 - RNA, 289 nt, synthetic construct
  source 1..289: mol_type = other RNA
cgctcttccgcgtctcttaagcttgcgcggcagccatatgggccctatgagcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54913 - RNA, 289 nt, synthetic construct
  source 1..289: mol_type = other RNA
cgctcttccgcgtctcttaagcttgcgcggcagccatatgggccctatggagagctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54914 - RNA, 289 nt, synthetic construct
  source 1..289: mol_type = other RNA
cgctcttccgcgtctcttaagcttgcgcggcagccatatgggccctatggagataagcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54915 - RNA, 289 nt, synthetic construct
  source 1..289: mol_type = other RNA
cgctcttccgcgtctcttaagcttgcgcggcagccatatgggccctatggagatatacagcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54916 - RNA, 289 nt, synthetic construct
  source 1..289: mol_type = other RNA
cgctcttccgcgtctcttaagcttgcgcggcagccatatgggccctatggagatatacaagagcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54917 - RNA, 289 nt, synthetic construct
  source 1..289: mol_type = other RNA
cgctcttccgcgtctcttaagcttgcgcggcagccatatgggccctatggagatatacaagacaagctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54918 - RNA, 289 nt, synthetic construct
  source 1..289: mol_type = other RNA
cgctcttccgcgtctcttaagcttgcgcggcagccatatgggccctatggagatatacaagacagtgagcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54919 - RNA, 289 nt, synthetic construct
  source 1..289: mol_type = other RNA
cgctcttccgcgtctcttaagcttgcgcggcagccatatgggccctatggagatatacaagacagtgtctagctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54920 - RNA, 289 nt, synthetic construct
  source 1..289: mol_type = other RNA
cgctcttccgcgtctcttaagcttgcgcggcagccatatgggccctatggagatatacaagacagtgtctgcaagcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54921 - RNA, 289 nt, synthetic construct
  source 1..289: mol_type = other RNA
cgctcttccgcgtctcttaagcttgcgcggcagccatatgggccctatggagatatacaagacagtgtctgcatggagcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54922 - RNA, 289 nt, synthetic construct
  source 1..289: mol_type = other RNA
cgctcttccgcgtctcttaagcttgcgcggcagccatatgggccctatggagatatacaagacagtgtctgcatggaagagccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54923 - RNA, 289 nt, synthetic construct
  source 1..289: mol_type = other RNA
cgctcttccgcgtctcttaagcttgcgcggcagccatatgggccctatggagatatacaagacagtgtctgcatggaagagaagcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54924 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagagcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54925 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaagccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54926 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgagcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54927 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggagcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54928 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaagcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54929 - RNA, 289 nt, synthetic construct; identical to SEQ ID NO: 54695
  source 1..289: mol_type = other RNA

SEQ ID NO: 54930 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcagcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54931 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcagcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54932 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54933 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaagcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54934 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacagcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54935 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcagcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54936 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacagcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54937 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagagcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54938 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaagcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54939 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaagcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54940 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54941 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtagcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54942 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgagcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54943 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcagcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54944 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcagcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54945 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgagcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54946 - RNA, 289 nt, synthetic construct; identical to SEQ ID NO: 54695
  source 1..289: mol_type = other RNA

SEQ ID NO: 54947 - RNA, 289 nt, synthetic construct
  source 1..289: mol_type = other RNA
cgctcttccgcgtctcttaagcacgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54948 - RNA, 289 nt, synthetic construct
  source 1..289: mol_type = other RNA
cgctcttccgcgtctcttaagcttgacgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54949 - RNA, 289 nt, synthetic construct
  source 1..289: mol_type = other RNA
cgctcttccgcgtctcttaagcttgcgcacgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54950 - RNA, 289 nt, synthetic construct
  source 1..289: mol_type = other RNA
cgctcttccgcgtctcttaagcttgcgcggcacgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54951 - RNA, 289 nt, synthetic construct
  source 1..289: mol_type = other RNA
cgctcttccgcgtctcttaagcttgcgcggcagcacgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54952 - RNA, 289 nt, synthetic construct
  source 1..289: mol_type = other RNA
cgctcttccgcgtctcttaagcttgcgcggcagccatacgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54953 - RNA, 289 nt, synthetic construct
  source 1..289: mol_type = other RNA
cgctcttccgcgtctcttaagcttgcgcggcagccatatgacgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54954 - RNA, 289 nt, synthetic construct
  source 1..289: mol_type = other RNA
cgctcttccgcgtctcttaagcttgcgcggcagccatatgggcacgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54955 - RNA, 289 nt, synthetic construct
  source 1..289: mol_type = other RNA
cgctcttccgcgtctcttaagcttgcgcggcagccatatgggccctacggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54956 - RNA, 289 nt, synthetic construct
  source 1..289: mol_type = other RNA
cgctcttccgcgtctcttaagcttgcgcggcagccatatgggccctatgacgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54957 - RNA, 289 nt, synthetic construct
  source 1..289: mol_type = other RNA
cgctcttccgcgtctcttaagcttgcgcggcagccatatgggccctatggagacgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54958 - RNA, 289 nt, synthetic construct
  source 1..289: mol_type = other RNA
cgctcttccgcgtctcttaagcttgcgcggcagccatatgggccctatggagataacgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54959 - RNA, 289 nt, synthetic construct
  source 1..289: mol_type = other RNA
cgctcttccgcgtctcttaagcttgcgcggcagccatatgggccctatggagatatacacgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54960 - RNA, 289 nt, synthetic construct
  source 1..289: mol_type = other RNA
cgctcttccgcgtctcttaagcttgcgcggcagccatatgggccctatggagatatacaagacggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54961 - RNA, 289 nt, synthetic construct
  source 1..289: mol_type = other RNA
cgctcttccgcgtctcttaagcttgcgcggcagccatatgggccctatggagatatacaagacaacgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54962 - RNA, 289 nt, synthetic construct
  source 1..289: mol_type = other RNA
cgctcttccgcgtctcttaagcttgcgcggcagccatatgggccctatggagatatacaagacagtgacggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54963 - RNA, 289 nt, synthetic construct
  source 1..289: mol_type = other RNA
cgctcttccgcgtctcttaagcttgcgcggcagccatatgggccctatggagatatacaagacagtgtctacgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54964 - RNA, 289 nt, synthetic construct
  source 1..289: mol_type = other RNA
cgctcttccgcgtctcttaagcttgcgcggcagccatatgggccctatggagatatacaagacagtgtctgcaacgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54965 - RNA, 289 nt, synthetic construct
  source 1..289: mol_type = other RNA
cgctcttccgcgtctcttaagcttgcgcggcagccatatgggccctatggagatatacaagacagtgtctgcatggacgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54966 - RNA, 289 nt, synthetic construct
  source 1..289: mol_type = other RNA
cgctcttccgcgtctcttaagcttgcgcggcagccatatgggccctatggagatatacaagacagtgtctgcatggaagacgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54967 - RNA, 289 nt, synthetic construct
  source 1..289: mol_type = other RNA
cgctcttccgcgtctcttaagcttgcgcggcagccatatgggccctatggagatatacaagacagtgtctgcatggaagagaacgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54968 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagacggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54969 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaacgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54970 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgacggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54971 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggacgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54972 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaacgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54973 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgacgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54974 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcacgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54975 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcacgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54976 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcacgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54977 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaacgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54978 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacacggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54979 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcacgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54980 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacacggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54981 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagacgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54982 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaacgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54983 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaacgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54984 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagacgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54985 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtacgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54986 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgacgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54987 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcacgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54988 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcacggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54989 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgacgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54990 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaacgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54991 - RNA, 289 nt, synthetic construct
  source 1..289: mol_type = other RNA
cgctcttccgcgtctcttaagcacccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54992 - RNA, 289 nt, synthetic construct
  source 1..289: mol_type = other RNA
cgctcttccgcgtctcttaagcttgaccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54993 - RNA, 289 nt, synthetic construct
  source 1..289: mol_type = other RNA
cgctcttccgcgtctcttaagcttgcgcaccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54994 - RNA, 289 nt, synthetic construct
  source 1..289: mol_type = other RNA
cgctcttccgcgtctcttaagcttgcgcggcacccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54995 - RNA, 289 nt, synthetic construct
  source 1..289: mol_type = other RNA
cgctcttccgcgtctcttaagcttgcgcggcagcaccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54996 - RNA, 289 nt, synthetic construct
  source 1..289: mol_type = other RNA
cgctcttccgcgtctcttaagcttgcgcggcagccataccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54997 - RNA, 289 nt, synthetic construct
  source 1..289: mol_type = other RNA
cgctcttccgcgtctcttaagcttgcgcggcagccatatgacccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54998 - RNA, 289 nt, synthetic construct
  source 1..289: mol_type = other RNA
cgctcttccgcgtctcttaagcttgcgcggcagccatatgggcaccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 54999 - RNA, 289 nt, synthetic construct
  source 1..289: mol_type = other RNA
cgctcttccgcgtctcttaagcttgcgcggcagccatatgggccctaccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55000 - RNA, 289 nt, synthetic construct
  source 1..289: mol_type = other RNA
cgctcttccgcgtctcttaagcttgcgcggcagccatatgggccctatgaccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55001 - RNA, 289 nt, synthetic construct
  source 1..289: mol_type = other RNA
cgctcttccgcgtctcttaagcttgcgcggcagccatatgggccctatggagacctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55002 - RNA, 289 nt, synthetic construct
  source 1..289: mol_type = other RNA
cgctcttccgcgtctcttaagcttgcgcggcagccatatgggccctatggagataaccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55003 - RNA, 289 nt, synthetic construct
  source 1..289: mol_type = other RNA
cgctcttccgcgtctcttaagcttgcgcggcagccatatgggccctatggagatatacaccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55004 - RNA, 289 nt, synthetic construct
  source 1..289: mol_type = other RNA
cgctcttccgcgtctcttaagcttgcgcggcagccatatgggccctatggagatatacaagaccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55005 - RNA, 289 nt, synthetic construct
  source 1..289: mol_type = other RNA
cgctcttccgcgtctcttaagcttgcgcggcagccatatgggccctatggagatatacaagacaacctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55006 - RNA, 289 nt, synthetic construct
  source 1..289: mol_type = other RNA
cgctcttccgcgtctcttaagcttgcgcggcagccatatgggccctatggagatatacaagacagtgaccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55007 - RNA, 289 nt, synthetic construct
  source 1..289: mol_type = other RNA
cgctcttccgcgtctcttaagcttgcgcggcagccatatgggccctatggagatatacaagacagtgtctacctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55008 - RNA, 289 nt, synthetic construct
  source 1..289: mol_type = other RNA
cgctcttccgcgtctcttaagcttgcgcggcagccatatgggccctatggagatatacaagacagtgtctgcaaccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55009 - RNA, 289 nt, synthetic construct
  source 1..289: mol_type = other RNA
cgctcttccgcgtctcttaagcttgcgcggcagccatatgggccctatggagatatacaagacagtgtctgcatggaccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55010 - RNA, 289 nt, synthetic construct
  source 1..289: mol_type = other RNA
cgctcttccgcgtctcttaagcttgcgcggcagccatatgggccctatggagatatacaagacagtgtctgcatggaagacccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55011 - RNA, 289 nt, synthetic construct
  source 1..289: mol_type = other RNA
cgctcttccgcgtctcttaagcttgcgcggcagccatatgggccctatggagatatacaagacagtgtctgcatggaagagaaccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55012 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagaccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55013 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaacccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55014 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgaccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55015 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggaccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55016 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaaccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55017 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgaccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55018 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcaccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc
